US010526378B2

(12) United States Patent
Busby et al.

(10) Patent No.: US 10,526,378 B2
(45) Date of Patent: Jan. 7, 2020

(54) METHODS AND MATERIALS FOR ENCAPSULATING PROTEINS

(71) Applicant: AGRESEARCH LTD, Hamilton (NZ)

(72) Inventors: Jason Nicholas Busby, Auckland (NZ); Jeremy Shaun Lott, Auckland (NZ); Mark Robin Holmes Hurst, Christchurch (NZ)

(73) Assignee: AgResearch Limited, Hamilton (NZ)

( * ) Notice: Subject to any disclaimer, the term of this patent is extended or adjusted under 35 U.S.C. 154(b) by 110 days.

(21) Appl. No.: 14/785,505

(22) PCT Filed: Apr. 17, 2014

(86) PCT No.: PCT/IB2014/060784
§ 371 (c)(1),
(2) Date: Oct. 19, 2015

(87) PCT Pub. No.: WO2014/170853
PCT Pub. Date: Oct. 23, 2014

(65) Prior Publication Data

US 2016/0075743 A1 Mar. 17, 2016

(30) Foreign Application Priority Data

Apr. 19, 2013 (NZ) ........................................ 609662

(51) Int. Cl.

| | |
|---|---|
| *C07K 14/24* | (2006.01) |
| *C07K 14/195* | (2006.01) |
| *C12N 15/82* | (2006.01) |
| *C12N 9/50* | (2006.01) |
| *A01N 37/18* | (2006.01) |
| *C12N 9/52* | (2006.01) |

(52) U.S. Cl.
CPC .............. *C07K 14/24* (2013.01); *A01N 37/18* (2013.01); *C07K 14/195* (2013.01); *C12N 9/50* (2013.01); *C12N 9/52* (2013.01); *C12N 15/8286* (2013.01); *C07K 2319/00* (2013.01); *C07K 2319/50* (2013.01); *C12Y 304/23* (2013.01)

(58) Field of Classification Search
CPC ...................................................... C07K 14/24
USPC .......................................................... 800/279
See application file for complete search history.

(56) References Cited

U.S. PATENT DOCUMENTS

| | | | |
|---|---|---|---|
| 4,795,855 | A | 1/1989 | Fillatti et al. |
| 4,943,674 | A | 7/1990 | Houck et al. |
| 5,004,863 | A | 4/1991 | Umbeck |
| 5,086,169 | A | 2/1992 | Mascarenhas |
| 5,159,135 | A | 10/1992 | Umbeck |
| 5,177,010 | A | 1/1993 | Goldman et al. |
| 5,187,073 | A | 2/1993 | Goldman et al. |
| 5,188,958 | A | 2/1993 | Moloney et al. |
| 5,412,085 | A | 5/1995 | Allen et al. |
| 5,416,011 | A | 5/1995 | Hinchee et al. |
| 5,463,174 | A | 10/1995 | Moloney et al. |
| 5,536,653 | A | 7/1996 | Barry et al. |
| 5,545,546 | A | 8/1996 | Allen et al. |
| 5,563,055 | A | 10/1996 | Townsend et al. |
| 5,569,834 | A | 10/1996 | Hinchee et al. |
| 5,591,616 | A | 1/1997 | Hiei et al. |
| 5,608,150 | A | 3/1997 | Conner |
| 5,639,952 | A | 6/1997 | Quail et al. |
| 5,656,496 | A | 8/1997 | Quail et al. |
| 5,750,385 | A | 5/1998 | Shewmaker et al. |
| 5,750,871 | A | 5/1998 | Moloney et al. |
| 5,792,935 | A | 8/1998 | Arntzen et al. |
| 5,824,877 | A | 10/1998 | Hinchee et al. |
| 5,837,848 | A | 11/1998 | Ely et al. |
| 5,846,797 | A | 12/1998 | Strickland |
| 5,952,543 | A | 9/1999 | Firoozabady et al. |
| 5,981,840 | A | 11/1999 | Zhao et al. |
| 6,020,539 | A | 2/2000 | Goldman et al. |
| 6,037,522 | A | 3/2000 | Dong et al. |
| 6,074,877 | A | 6/2000 | D'Halluin et al. |
| 6,127,179 | A | 10/2000 | DellaPenna et al. |

(Continued)

FOREIGN PATENT DOCUMENTS

| | | |
|---|---|---|
| WO | WO 2002/000894 A2 | 1/2002 |
| WO | 2005/084355 | 9/2005 |
| WO | WO 2011/053169 A1 | 5/2011 |

OTHER PUBLICATIONS

Adams et al. (2010) "PHENIX: a comprehensive Python-based system for macromolecular structure solution," Acta Crystallogr. D. 66:213-221.

(Continued)

*Primary Examiner* — Li Zheng

(74) *Attorney, Agent, or Firm* — Leydig, Voit & Mayer, Ltd.

(57) ABSTRACT

The invention provides a method for encapsulating a protein of interest, the method comprising the step of expressing a fusion protein comprising an N-terminal region of a rearrangement hot spot (RHS)-repeat-containing protein fused to the protein of interest. The invention further provides applications for the encapsulation, release and delivery of the protein of interest. The invention also encompasses the encapsulated protein of interest and compositions comprising the encapsulated protein of interest. The invention also provides uses of the encapsulated protein of interest, optionally after release from encapsulation, to control pests. The encapsulated protein of interest may for example be produced via expression in a plant to control a pest of the plant, such as an insect pest.

8 Claims, 74 Drawing Sheets

Specification includes a Sequence Listing.

(56) References Cited

U.S. PATENT DOCUMENTS

| | | | |
|---|---|---|---|
| 6,184,443 | B1 | 2/2001 | Pedersen et al. |
| 6,228,643 | B1 | 5/2001 | Greenland et al. |
| 6,229,067 | B1 | 5/2001 | Sonnewald et al. |
| 6,342,657 | B1 | 1/2002 | Thomas et al. |
| 7,081,565 | B2 | 7/2006 | Ohlrogge et al. |
| 7,141,424 | B2 | 11/2006 | Shin et al. |
| 7,153,953 | B2 | 12/2006 | Marraccini et al. |
| 7,371,928 | B2 | 5/2008 | Suh et al. |
| 7,405,345 | B2 | 7/2008 | Ohlrogge et al. |
| 7,629,454 | B2 | 12/2009 | Chan et al. |
| 7,642,346 | B2 | 1/2010 | Chaudhary et al. |
| 7,655,838 | B2 | 2/2010 | Guzov et al. |
| 7,667,097 | B2 | 2/2010 | Scheirlinck et al. |
| 7,745,697 | B2 | 6/2010 | Perez et al. |
| 7,803,993 | B2 | 9/2010 | Abad et al. |
| 7,858,849 | B2 | 12/2010 | Cerf et al. |
| 7,919,609 | B2 | 4/2011 | Boets et al. |
| 8,034,997 | B2 | 10/2011 | Bogdanova et al. |
| 8,216,806 | B2 | 7/2012 | Chen et al. |
| 8,247,369 | B2 | 8/2012 | Chen et al. |
| 8,273,872 | B2 | 9/2012 | Buchanan et al. |
| 2001/0047525 | A1 | 11/2001 | Bruce et al. |
| 2004/0067506 | A1 | 4/2004 | Scheres et al. |
| 2006/0168683 | A1* | 7/2006 | Hey ............ C07K 14/195 800/279 |
| 2006/0205653 | A1 | 9/2006 | Larrinua et al. |

OTHER PUBLICATIONS

Alam et al. (1999) "Transgenic insect-resistant maintainer line (IR68899B) for improvement of hybrid rice," Plant Cell Rep. 18:572-575.

Altpeter et al. (2004) "Comparison of Transgene Expression Stability after Agrobacterium-mediated or Biolistic Gene Transfer into Perennial Ryegrass (*Lolium perenne* L.)," Developments in Plant Breeding. 11(7):255-260.

Altschul et al. (1997) "Gapped BLAST and PSI-BLAST: a new generation of protein database search programs," Nucleic Acids Res. 25:3389-3402.

Bairoch et al. (1994) "PROSITE: recent developments," Nucleic Acids Res. 22:3583-3589.

Baxevanis (2001) "The Molecular Biology Database Collection: an updated compilation of biological database resources," Nucleic Acids Res. 29:1-10.

Birch (1997) "Plant Transformations: Problems and Strategies for Practical Applications," Ann. Rev. Plant Phys. Plant Mol. Biol. 48:297-326.

Blommel et al. (2007) "A combined approach to improving large-scale production of tobacco etch virus protease," Protein Expression and Purification. 55(1):53-68.

Bolton et al. (1962) "A General Method for the Isolation of RNA Complementary to DNA," Proc. Natl. Acad. Sci. USA. 48:1390-1397.

Bowen et al. (1998) "Insecticidal toxins from the bacterium Photorhabdus luminescens," Science. 280:2129-2132.

Bowie et al. (1990) "Deciphering the message in protein sequences: tolerance to amino acid substitutions," Science. 247:1306-1310.

Buetow et al. (2001) "Structure of the Rho-activating domain of *Escherichia coli* cytotoxic necrotizing factor 1," Nat. Struct. Biol. 8:584-588.

Busby et al. (2012) "Structural analysis of Chi1 Chitinase from Yen-Tc: the multisubunit insecticidal ABC toxin complex of Yersinia entomophaga," J. Mol. Biol. 415:359-371.

Busby et al. (2013) "The BC component of ABC toxins is an RHS-repeat-containing protein encapsulation device," Nature. 501:547-550.

Cardoza et al. (2006) "Canola (*Brassica napus* L.)," Methods Mol. Biol. 343:257-266.

Chand et al. (Sep. 28, 2012) "C-terminal processing of the teneurin proteins: independent actions of a teneurin C-terminal associated peptide in hippocampal cells," Mol. Cell. Neurosci. 52:38-50.

Christou et al. (1991) "Production of Transgenic Rice (*Oryza sativa* L.) Plants from Agronomically Important Indica and Japonica Varieties via Electric Discharge Particle Acceleration of Exogenous DNA into Immature Zygotic Embryos," Nature Biotech. 9:957-962.

Collaborative Computational Project, No. 4 (1994) "The CCP4 suite: programs for protein crystallography," Acta Crystallogr. D. 50:760-763.

Dan et al. (2006) "MicroTom—a high-throughput model transformation system for functional genomics," Plant Cell Reports. 25:432-441.

Ditta et al. (1980) "Broad host range DNA cloning system for gram-negative bacteria: construction of a gene bank of Rhizobium meliloti," Proc. Natl. Acad. Sci. USA. 77:7347-7351.

Ellerström et al. (1996) "Functional dissection of a napin gene promoter: identification of promoter elements required for embryo and endosperm-specific transcription," Plant Molecular Biology. 32(6):1019-1027.

Falquet et al. (2002) "The PROSITE database, its status in 2002," Nucleic Acids Res. 30:235-238.

Feng et al. (1987) "Progressive sequence alignment as a prerequisite to correct phylogenetic trees," J. Mol. Evol. 25:351-360.

Feng et al. (2002) "All four members of the Ten-m/Odz family of transmembrane proteins form dimers," J. Biol. Chem. 277:26128-26135.

Ffrench-Constant et al. (2006) "Ground control for insect pests," Nat. Biotechnol. 24:660-661.

Folta et al. (2006) "Characterization of LF9, an octoploid strawberry genotype selected for rapid regeneration and transformation," Planta. 224(5):1058-1067.

Franke et al. (2009) "DAMMIF, a program for rapid ab-initio shape determination in small-angle scattering," J. Appl. Crystallogr. 42:342-346.

Frohman (1993) "Rapid amplification of complementary DNA ends for generation of full-length complementary DNAs: thermal RACE," Methods Enzymol. 218:340-356.

Gatsogiannis et al. (Mar. 20, 2013) "A syringe-like injection mechanism in Photorhabdus luminescens toxins," Nature. 495:520-523.

Giesen et al. (1998) "A formula for thermal stability (Tm) prediction of PNA/DNA duplexes," Nucleic Acids Res. 26(21):5004-5006.

Gleave (1992) "A versatile binary vector system with a T-DNA organisational structure conducive to efficient integration of cloned DNA into the plant genome," Plant Mol. Biol. 20:1203-1207.

Gonzalez Padilla et al. (2003) "Early antibiotic selection and efficient rooting and acclimatization improve the production of transgenic plum plants (*Prunus domestica* L.)," Plant Cell Rep. 22(1):38-45.

Graham et al. (1995) "Agrobacterium-mediated transformation of soft fruit Rubus, Ribes, and Fragaria," Methods Mol. Biol. 44:129-133.

Hares et al. (2008) "The Yersinia pseudotuberculosis and Yersinia pestis toxin complex is active against cultured mammalian cells," Microbiology. 154:3503-3517.

Hellens et al. (2000) "pGreen: a versatile and flexible binary Ti vector for Agrobacterium-mediated plant transformation," Plant Mol. Biol. 42:819-832.

Hellens et al. (2005) "Transient expression vectors for functional genomics, quantification of promoter activity and RNA silencing in plants," Plant Methods. 1:13 pp. 1-14.

Hill et al. (1994) "Rhs elements of *Escherichia coli*: a family of genetic composites each encoding a large mosaic protein," Mol. Microbiol. 12:865-871.

Hofmann et al. (1999) "The PROSITE database, its status in 1999," Nucleic Acids Res. 27:215-219.

Hong et al. (2012) "Teneurins instruct synaptic partner matching in an olfactory map," Nature. 484:201-207.

Horsch et al. (1985) "A simple and general method for transferring genes into plants," Science. 227:1229-1231.

Howe et al. (2006) "Rapid and reproducible Agrobacterium-mediated transformation of sorghum," Plant Cell Reports. 25(8):784-791.

Huang (1994) "On Global Sequence Alignment," Computer Applications in the Biosciences. 10:227-235.

(56) References Cited

OTHER PUBLICATIONS

Hurst et al. (2011) "The Main Virulence Determinant of Yersinia entomophaga MH96 Is a Broad-Host-Range Toxin Complex Active against Insects," J. Bacteriol. 193(8):1966-1980.
International Preliminary Report on Patentability corresponding to International Patent Application No. PCT/IB2014/060784, completed Mar. 17, 2015.
International Search Report with Written Opinion corresponding to International Patent Application No. PCT/IB2014/060784, dated Jul. 1, 2014.
InterPro: Protein Sequence Analysis & Classification "Rhs repeat-associated core (IPR022385)," EMBL-EBI. Accessible on the Internet at URL: http://www.ebi.ac.uk/interpro/entry/IPR022385. [Last Accessed Feb. 17, 2016].
Iyer et al. (2011) "Evolution of the deaminase fold and multiple origins of eukaryotic editing and mutagenic nucleic acid deaminases from bacterial toxin systems," Nucleic Acids Res. 39:9473-9497.
Jackson et al. (2009) "Evolutionary diversification of an ancient gene family (rhs) through C-terminal displacement," BMC Genomics. 10:584.
Jang et al. (2006) "Functional classification, genomic organization, putatively cis-acting regulatory elements, and relationship to quantitative trait loci, of sorghum genes with rhizome-enriched expression," Plant Physiol. 142:1148-1159.
Jeanmougin et al. (1998) "Multiple sequence alignment with Clustal X," Trends Biochem. Sci. 23:403-405.
Josefsson et al. (1987) "Structure of a gene encoding the 1.7 S storage protein, napin, from *Brassica napus*," J. Biol. Chem. 262(25):12196-12201.
Kabsch (2010) "XDS," Acta Crystallogr. 66:125-132.
Krens et al. (1997) "Transgenic caraway, *Carum carvi* L.: a model species for metabolic engineering," Plant Cell Rep. 17:39-43.
Kumar et al. (1996) "Potato plants expressing antisense and sense S-adenosylmethionine decarboxylase (SAMDC) transgenes show altered levels of polyamines and ethylene: antisense plants display abnormal phenotypes," Plant J. 9(2):147-158.
Landsberg et al. (2011) "3D structure of the Yersinia entomophaga toxin complex and implications for insecticidal activity," Proc. Natl. Acad. Sci. USA. 108:20544-20549.
Lang et al. (2010) "Photorhabdus luminescens Toxins ADP-Ribosylate Actin and RhoA to Force Actin Clustering," Science. 327:1139-1142.
et al. (1996) "Genetic transformation of cassava (*Manihot esculenta* Crantz)," Nat. Biotechnol. 14:736-740.
Li et al. (2003) "Transgenic rose lines harboring an antimicrobial protein gene, Ace-AMP1, demonstrate enhanced resistance to powdery mildew (*Sphaerotheca pannosa*)," Planta. 218:226-232.
Matsuda et al. (2005) "Development of an Agrobacterium-mediated transformation.method for pear (*Pyrus communis* L.) with leaf-section and axillary shoot-meristem explants," Plant Cell Rep. 24(1):45-51.
McNulty et al. (2006) "The cell surface expression of group 2 capsular polysaccharides in *Escherichia coli*: the role of KpsD, RhsA and a multi-protein complex at the pole of the cell," Mol. Microbiol. 59(3):907-922.
McPhillips et al. (2002) "Blu-Ice and the Distributed Control System: software for data acquisition and instrument control at macromolecular crystallography beamlines," J. Synchrotron Radiat. 9:401-406.
Michelmore et al. (1987) "Transformation of lettuce (*Lactuca sativa*) mediated by Agrobacterium tumefaciens," Plant Cell Rep. 6:439-442.
Minet et al. (1999) "Teneurin-1, a vertebrate homologue of the *Drosophila* pair-rule gene ten-m, is a neuronal protein with a novel type of heparin-binding domain." J. Cell. Sci. 112:2019-2032.
Mosca et al. (2012) "Trans-synaptic Teneurin signalling in neuromuscular synapse organization and target choice," Nature. 484:237-241.
Needleman et al. (1970) "A general method applicable to the search for similarities in the amino acid sequence of two proteins," J. Mol. Biol. 48:443-453.
Nielsen et al. (1991) "Sequence-selective recognition of DNA by strand displacement with a thymine-substituted polyamide," Science. 254(5037):1497-1500.
Niu et al. (1998) "Transgenic peppermint (*Mentha* × *piperita* L.) plants obtained by cocultivation with Agrobacterium tumefaciens," Plant Cell Rep. 17:165-171.
Notredame et al. (2000) "A novel method for fast and accurate multiple sequence alignment," J. Mol. Biol. 302:205-217.
Oosumi et al. (2006) "High-efficiency transformation of the diploid strawberry (*Fragaria vesca*) for functional genomics," Planta. 223(6):1219-1230.
Orlikowska et al. (1995) "Factors influencing Agrobacterium tumefaciens-mediated transformation and regeneration of the safflower cultivar 'centennial,'" Plant Cell Tissue and Organ Culture. 40:85-91.
Orthaber et al. (2000) "SAXS experiments on absolute scale with Kratky systems using water as a secondary standard," J. Appl. Crystallogr. 33:218-225.
Ortiz et al. (1996) "Hygromycin resistance as an efficient selectable marker for wheat stable transformation," Plant Cell Rep. 15:877-881.
Panjikar et al. (2005) "Auto-Rickshaw: an automated crystal structure determination platform as an efficient tool for the validation of an X-ray diffraction experiment," Acta Crystallogr. D. 61:449-457.
Panjikar et al. (2009) "On the combination of molecular replacement and single-wavelength anomalous diffraction phasing for automated structure determination," Acta Crystallogr. D. 65:1089-1097.
Pena et al. (1995) "High efficiency Agrobacterium-mediated transformation and regeneration of citrus," Plant Sci. 104:183-191.
Pettersen et al. (2004) "UCSF Chimera—a visualization system for exploratory research and analysis," J. Comput. Chem. 25:1605-1612.
Ramesh et al. (2006) "Improved methods in Agrobacterium-mediated transformation of almond using positive (mannose/pmi) or negative (kanamycin resistance) selection-based protocols," Plant Cell Rep. 25(8):821-828.
Rice et al. (2000) "EMBOSS: The European Molecular Biology Open Software Suite," Trends in Genetics. 16(6):276-277.
Schenk et al. (2001) "Promoters for pregenomic RNA of banana streak badnavirus are active for transgene expression in monocot and dicot plants," Plant Molecular Biology. 47:399-412.
Sheets et al. (2011) "Insecticidal toxin complex proteins from Xenorhabdus nematophilus: structure and pore formation," J. Biol. Chem. 286:22742-22749.
Smeets et al. (1997) "Developmental Regulation of Lectin and Alliinase Synthesis in Garlic Bulbs and Leaves," Plant Physiol. 113:765-771.
Song et al. (2005) "Transformation of Montmorency sour cherry (*Prunus cerasus* L.) and Gisela 6 (*P. cerasus* × *P. canescens*) cherry rootstock mediated by Agrobacterium tumefaciens," Plant Cell Rep. 25(2):117-123.
Studier (2005) "Protein production by auto-induction in high density shaking cultures," Protein Expression and Purification. 41(1):207-234.
Svergun et al. (1995) "CRYSOL—a Program to Evaluate X-ray Solution Scattering of Biological Macromolecules from Atomic Coordinates," J. Appl. Crystallogr. 28:768-773.
Svergun et al. (1999) "Restoring low resolution structure of biological macromolecules from solution scattering using simulated annealing," Biophys. J. 76::2879-2886.
Tatusova et al. (1999) "Blast 2 sequences—a new tool for comparing protein and nucleotide sequences," FEMS Microbiol. Lett. 174:247-250.
Tatusova et al. (1999) "Erratum: Blast 2 sequences—a new tool for comparing protein and nucleotide sequences [FEMS Microbiol. 174 (1999) 247-250]," FEMS Microbiol. Lett. 177:187-188.
Thompson et al. (1994) "CLUSTAL W: improving the sensitivity of progressive multiple sequence alignment through sequence weight-

(56) References Cited

OTHER PUBLICATIONS ing, position-specific gap penalties and weight matrix choice," Nucleic Acids Res. 22:4673-4680.

Triglia et al. (1988) "A procedure for in vitro amplification of DNA segments that lie outside the boundaries of known sequences," Nucleic Acids Res. 16:8186.

Tucker et al. (2006) "Teneurins: a conserved family of transmembrane proteins involved in intercellular signaling during development," Dev Biol. 290(2):237-245.

Volkov et al. (2003) "Uniqueness of ab initio shape determination in small-angle scattering," J. Appl. Crystallogr. 36:860-864.

Wang et al. (1998) "Rhs elements comprise three subfamilies which diverged prior to acquisition by *Escherichia coli*," J. Bacteriol. 180:4102-4110.

Wang et al. (2006) "Transformation of Actinidia eriantha: a potential species for functional genomics studies in Actinidia," Plant Cell Rep. 25(5):425-431.

Wang et al. (2009) "Maize Transformation," In; Handbook of Maize. Bennetzen, J. L.; Hake, S. C.: Eds. Springer-Verlag. New York, New York. pp. 609-639.

Waterfield et al. (2005) "Potentiation and cellular phenotypes of the insecticidal Toxin complexes of Photorhabdus bacteria," Cell. Microbiol. 7:373-382.

Wheeler et al. (2001) "Database resources of the National Center for Biotechnology Information," Nucleic Acids Res. 29:11-16.

Woelfle et al. (Apr. 2015) "Ancient interaction between the teneurin C-terminal associated peptides (TCAP) and latrophilin ligand-receptor coupling: a role in behavior," Frontiers in Bioscience. 9:146. pp. 1-10.

Xu et al. (1997) "The crystal structure of the asymmetric GroEL-GroES-(ADP)7 chaperonin complex," Nature. 388:741-750.

Yao et al. (1995) "Regeneration of transgenic plants from the commercial apple cultivar Royal Gala," Plant Cell Reports. 14:407-412.

Zhang et al. (Jun. 25, 2012) "Polymorphic toxin systems: Comprehensive characterization of trafficking modes, processing, mechanisms of action, immunity and ecology using comparative genomics," Biol. Direct. 7:18.

New Zealand First Office Action, dated Jul. 29, 2014, in New Zealand Patent Application No. 627323, a related application, 2 pp.

European Search Report, dated Oct. 7, 2016, corresponding to International Application No. PCT/IB2014/060784 (filed Apr. 17, 2014), parent of the present application, 14 pp.

European First Office Action, dated Feb. 26, 2018, corresponding to European Application No. 14786060.5 (filed Apr. 17, 2014), a related application, 7 pp.

Peng et al. (2003) "A Delta-Endotoxin Encoded in *Pseudomonas fluorescens* Displays a High Degree of Insecticidal Activity," Applied Microbiology and Biotechnology 63(3): 300-306.

Sutter et al. (2008) "Structural Basis of Enzyme Encapsulation into a Bacterial Nanocompartment," Nature Structural and Molecular Biology 15(9): 939-947.

\* cited by examiner

```
HMMER3/b [3.0 | March 2010]
NAME  RHS_repeat
ACC   PF05593.9
DESC  RHS Repeat
LENG  38
ALPH  amino
RF    no
CS    no
MAP   yes
DATE  Fri Oct  5 07:01:01 2012
NSEQ  203
EFFN  203.000000
CKSUM 2066871730
GA    20.80 20.00;
TC    20.80 20.00;
NC    20.70 19.90;
BM    hmmbuild HMM.ann SEED.ann
SM    hmmsearch -Z 23193494 -E 1000 --cpu 4 HMM pfamseq
STATS LOCAL MSV       -7.8426  0.72260
STATS LOCAL VITERBI   -8.3520  0.72260
STATS LOCAL FORWARD   -3.6932  0.72260
```

Fig. 12

| ITEM | A m->m | C m->i | D m->d | E i->m | F i->i | G d->m | H d->d | I | K | L |
|---|---|---|---|---|---|---|---|---|---|---|
| COMBO | 2.51839 | 5.73794 | 2.37240 | 2.96254 | 4.34449 | 2.29407 | 3.82298 | 3.56912 | 3.49201 | 2.59079 |
|  | 2.68618 | 4.42225 | 2.77519 | 3.73123 | 3.46354 | 2.40513 | 3.72494 | 3.29354 | 2.67741 | 2.69355 |
|  | 0.00020 | 8.80003 | 9.62238 | 0.61958 | 0.77255 | 0.00000 |  |  |  |  |
| 1 | 5.25620 | 9.86120 | 9.74585 | 9.79777 | 2.64911 | 4.00040 | 3.73353 | 0.61780 | 9.52324 | 7.66983 |
|  | 2.68618 | 4.42225 | 2.77519 | 2.73123 | 3.46354 | 2.40513 | 3.72494 | 3.29354 | 2.67741 | 2.69355 |
|  | 0.00296 | 8.80003 | 5.87150 | 0.61958 | 0.77255 | 0.48576 | 0.95510 |  |  |  |
| 2 | 6.52754 | 9.02981 | 0.31247 | 4.23088 | 8.31569 | 7.08992 | 4.50515 | 7.81451 | 6.29390 | 4.76187 |
|  | 2.68681 | 4.42288 | 2.77334 | 2.73186 | 3.46417 | 2.40576 | 3.72557 | 3.29417 | 2.67534 | 2.69418 |
|  | 0.05009 | 3.47079 | 4.03067 | 0.02043 | 3.90080 | 0.32591 | 1.27967 |  |  |  |
| 3 | 1.40010 | 8.41929 | 2.36418 | 1.76193 | 7.76572 | 2.71129 | 4.55863 | 7.25266 | 3.50006 | 4.09455 |
|  | 2.68618 | 4.42225 | 2.77519 | 2.73123 | 3.46354 | 2.40513 | 3.72494 | 3.29354 | 2.67741 | 2.69355 |
|  | 0.00021 | 8.88223 | 9.60457 | 0.61958 | 0.77255 | 0.11795 | 2.13591 |  |  |  |
| 4 | 1.93615 | 8.43362 | 2.46536 | 3.05828 | 4.18842 | 4.76046 | 2.33478 | 4.13983 | 3.53594 | 2.21853 |
|  | 2.68618 | 4.42225 | 2.77519 | 2.73123 | 3.46354 | 2.40513 | 3.72494 | 3.29354 | 2.67741 | 2.69355 |
|  | 0.00020 | 8.80003 | 9.62238 | 0.61958 | 0.77255 | 0.48576 | 0.95510 |  |  |  |
| 5 | 7.53466 | 10.41321 | 2.35298 | 4.85859 | 9.63087 | 0.29555 | 3.22880 | 9.25982 | 5.28397 | 3.94270 |
|  | 2.68618 | 4.42225 | 2.77519 | 2.73123 | 3.46354 | 2.40513 | 3.72494 | 3.29354 | 2.67741 | 2.30665 |
|  | 0.00020 | 8.80003 | 9.62238 | 0.61958 | 0.77255 | 0.48576 | 0.95510 |  |  |  |
| 6 | 4.21318 | 8.43639 | 3.16505 | 3.69967 | 5.07494 | 4.58240 | 3.37280 | 7.26357 | 3.11813 |  |

| | M | N | P | Q | R | S | T | V | W | Y |
|---|---|---|---|---|---|---|---|---|---|---|
| | 4.75503 | 3.14249 | 3.52478 | 3.21902 | 2.50846 | 2.60291 | 2.20236 | 2.96971 | 4.50303 | 2.72159 |
| | 4.24690 | 2.90347 | 2.73739 | 3.18146 | 2.89801 | 2.37887 | 2.77519 | 2.98510 | 4.58477 | 3.61503 |
| 1 | 9.09878 | 4.44569 | 9.63071 | 9.06958 | 3.75992 | 8.82047 | 9.26138 | 4.78097 | 2.19956 | 0.30246 |
| | 4.24690 | 2.90347 | 2.73739 | 3.18146 | 2.89801 | 2.37887 | 2.77519 | 2.98510 | 4.58477 | 3.61503 |
| 2 | 5.66462 | 1.93011 | 5.19247 | 6.56688 | 6.82575 | 3.16333 | 4.21845 | 7.39834 | 4.88758 | 4.89233 |
| | 4.24753 | 2.90409 | 2.73802 | 3.18209 | 2.89624 | 2.37950 | 2.77583 | 2.98581 | 4.58540 | 3.60986 |
| 4 | 3.52705 | 5.42995 | 3.25739 | 4.25423 | 2.47550 | 1.97737 | 3.65740 | 3.61246 | 6.85116 | 5.70793 |
| | 4.24690 | 2.90347 | 2.73739 | 3.18146 | 2.89801 | 2.37887 | 2.77519 | 2.98510 | 4.58477 | 3.61503 |
| 5 | 7.47429 | 2.25736 | 4.54413 | 2.89026 | 2.17054 | 2.97609 | 3.09230 | 2.92404 | 5.02171 | 4.95670 |
| | 4.24690 | 2.90347 | 2.73739 | 3.18146 | 2.89801 | 2.37887 | 2.77519 | 2.98510 | 4.58477 | 3.61503 |
| 6 | 9.60534 | 3.02601 | 8.23651 | 3.88367 | 8.23738 | 5.04868 | 4.43588 | 8.75234 | 10.81130 | 9.12717 |
| | 4.24690 | 2.90347 | 2.73739 | 3.18146 | 2.89801 | 2.37887 | 2.77519 | 2.98510 | 4.58477 | 3.61503 |
| 7 | 5.10405 | 1.73776 | 4.79960 | 2.11464 | 0.95246 | 5.88456 | 5.20563 | 6.82771 | 4.12780 | 7.45663 |

| num | A | C | D | E | F | G | H | I | K | L |
|---|---|---|---|---|---|---|---|---|---|---|
| 7 | 2.68618 | 4.42225 | 2.77519 | 2.73123 | 3.46354 | 2.40513 | 3.72494 | 3.29354 | 2.67741 | 2.69355 |
|  | 0.00020 | 0.90003 | 9.62238 | 0.61958 | 0.77255 | 0.48576 | 0.95510 | 0.99971 | 7.27525 | 0.41327 |
|  | 3.87808 | 5.56008 | 8.11028 | 4.50099 | 6.59579 | 7.30240 | 7.63673 |  |  |  |
| 8 | 2.68618 | 4.42225 | 2.77519 | 2.73123 | 3.46354 | 2.40513 | 3.72494 | 3.29354 | 2.67741 | 2.69355 |
|  | 0.00177 | 0.90003 | 6.41957 | 0.61958 | 0.77255 | 0.48576 | 0.95510 | 2.12051 | 3.11448 | 2.14109 |
|  | 3.48143 | 7.54706 | 7.75755 | 3.41807 | 6.64543 | 7.24400 | 7.55870 |  |  |  |
| 9 | 2.68618 | 4.42225 | 2.77519 | 2.73123 | 3.46354 | 2.40513 | 3.72494 | 3.29354 | 2.67741 | 2.69355 |
|  | 0.00858 | 0.89847 | 4.77822 | 1.68454 | 0.77255 | 0.68277 | 0.70363 | 7.26047 | 3.22123 | 4.47632 |
|  | 1.89430 | 0.43702 | 4.19826 | 2.48148 | 7.77350 | 2.66485 | 3.75940 |  |  |  |
| 10 | 2.67516 | 4.43164 | 2.78459 | 2.71928 | 3.47293 | 2.40635 | 3.70712 | 3.27632 | 2.68680 | 2.69206 |
|  | 0.29817 | 2.44913 | 1.76343 | 1.68454 | 0.20522 | 0.79507 | 0.60065 | 2.00923 | 2.16631 | 2.84022 |
|  | 2.56316 | 7.44862 | 7.11716 | 2.48148 | 5.19359 | 6.95357 | 4.33548 |  |  |  |
| 11 | 2.68618 | 4.42225 | 2.77519 | 2.73123 | 3.46648 | 2.40513 | 3.72494 | 3.29354 | 2.67741 | 2.69355 |
|  | 0.00025 | 0.70609 | 3.42844 | 0.61454 | 0.77255 | 3.72676 | 0.02437 | 3.37370 | 3.20628 | 5.20622 |
|  | 2.47241 | 8.08394 | 2.82264 | 3.61454 | 4.98038 | 5.23705 | 4.42991 |  |  |  |
| 12 | 2.68912 | 4.42519 | 2.77293 | 2.73185 | 3.46648 | 2.40806 | 3.72476 | 3.29311 | 2.68034 | 2.69408 |
|  | 0.00025 | 1.74097 | 1.76373 | 0.00449 | 5.40787 | 3.26684 | 0.03928 | 3.29311 | 3.20628 | 5.20622 |
|  | 3.20011 | 6.07115 | 0.73819 | 3.45081 | 5.06362 | 5.29531 | 4.86063 | 6.90439 | 4.26022 | 2.81192 |

Fig. 12 cont.

| X | N | P | Q | R | S | T | U | W | Y | |
|---|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 | |
| 5.43588 | 7.46976 | 3.44501 | 4.68698 | 3.94569 | 6.61432 | 3.85808 | 1.83741 | 0.12610 | 4.82775 | 8 |
| 4.24690 | 2.90347 | 2.73739 | 3.18146 | 2.89801 | 2.37887 | 2.77519 | 2.98518 | 4.58477 | 3.61503 | 9 |
| 3.13129 | 7.29393 | 7.61114 | 4.22468 | 3.26208 | 3.62603 | 1.01324 | 1.81758 | 0.16293 | 6.97807 | |
| 4.24690 | 2.90347 | 2.73739 | 3.18146 | 2.89801 | 2.37887 | 2.77519 | 2.98518 | 4.58477 | 3.61503 | 10 |
| 7.46731 | 3.81979 | 7.07983 | 4.75422 | 2.39612 | 1.71773 | 2.21480 | 4.45701 | 0.85886 | 4.82155 | |
| 4.35629 | 2.91286 | 2.73657 | 3.19086 | 2.90133 | 2.38826 | 2.77279 | 2.93458 | 4.59416 | 3.56174 | 17 |
| 4.08648 | 6.83696 | 7.32673 | 2.14977 | 2.93401 | 2.85450 | 3.30786 | 1.62211 | 4.29403 | 4.03501 | |
| 4.24690 | 2.90347 | 2.73739 | 3.18146 | 2.89801 | 2.37887 | 2.77519 | 2.98518 | 4.58477 | 3.61503 | 18 |
| 5.10716 | 5.10860 | 6.95342 | 5.88280 | 3.30617 | 2.65715 | 0.74370 | 2.17119 | 0.56006 | 4.11572 | |
| 4.24983 | 2.90268 | 2.74033 | 3.18267 | 2.88444 | 0.37930 | 2.77454 | 2.98550 | 4.57645 | 3.61042 | 20 |
| 5.02857 | 0.91427 | 3.67199 | 3.70649 | 3.47341 | 2.17620 | 3.20902 | 0.46240 | 0.50306 | 3.72834 | |

Fig. 12 cont.

| Exam | A | C | D | E | F | G | H | I | K | L |
|---|---|---|---|---|---|---|---|---|---|---|
| 13 | 2.69918 | 4.43525 | 2.77359 | 2.72972 | 3.47694 | 2.40763 | 3.73795 | 3.23324 | 2.69041 | 2.67928 |
|  | 0.14398 | 2.00992 | 9.24439 | 1.93985 | 0.15516 | 0.02416 | 3.73508 | 3.63754 | 4.53100 | 2.67020 |
|  | 1.53355 | 4.31970 | 3.22825 | 3.10073 | 5.26924 | 3.37315 | 4.65439 | 3.65200 | 4.53100 | 2.67020 |
| 14 | 2.68618 | 4.42225 | 2.77519 | 2.73123 | 3.46354 | 2.40513 | 3.72494 | 3.29354 | 2.67741 | 2.69355 |
|  | 0.00020 | 8.89510 | 9.61744 | 0.61958 | 0.77255 | 0.48576 | 1.47735 | 3.78041 | 3.65930 | 2.18455 |
|  | 2.63351 | 3.26652 | 2.02860 | 2.94439 | 5.22262 | 2.65398 | 4.26044 |  |  |  |
| 15 | 2.68618 | 4.42225 | 2.77519 | 2.73123 | 3.46354 | 2.40513 | 3.72494 | 3.29354 | 2.67741 | 2.69355 |
|  | 0.00020 | 8.90003 | 9.62238 | 0.61958 | 0.77255 | 0.48576 | 0.95510 | 5.37283 | 5.61801 | 5.00775 |
|  | 3.35108 | 8.43635 | 1.03011 | 4.14075 | 7.77848 | 0.59840 | 4.11243 |  |  |  |
| 16 | 2.68618 | 4.42225 | 2.77519 | 2.73123 | 3.46354 | 2.40513 | 3.72494 | 3.29354 | 2.67741 | 2.69355 |
|  | 0.00020 | 8.90003 | 9.62238 | 0.61958 | 0.77255 | 0.48576 | 0.95510 | 4.65231 | 2.77470 | 2.50935 |
|  | 2.49964 | 8.43635 | 2.81280 | 3.02042 | 7.78267 | 2.92858 | 4.35825 |  |  |  |
| 17 | 2.68618 | 4.42225 | 2.77519 | 2.73123 | 3.46354 | 2.40513 | 3.72494 | 3.29354 | 2.67741 | 2.69355 |
|  | 0.00020 | 8.90003 | 9.62238 | 0.61958 | 0.77255 | 0.48576 | 0.95510 | 3.62281 | 3.15963 | 3.14855 |
|  | 2.89926 | 5.62415 | 5.06782 | 2.21133 | 4.32711 | 4.09118 | 4.52426 |  |  |  |
| 18 | 2.68618 | 4.42225 | 2.77519 | 2.73123 | 3.46354 | 2.40513 | 3.72494 | 3.29354 | 2.67741 | 2.69355 |
|  | 0.00020 | 8.90003 | 9.62238 | 0.61958 | 0.77255 | 0.48576 | 0.95510 | 2.93521 | 4.46987 | 2.78563 |
|  | 2.98134 | 8.18370 | 5.15129 | 4.11198 | 5.63054 | 2.02293 | 6.98694 |  |  |  |

Fig. 12 cont.

| x | z | a | b | c | R | 9 | s | t | w | y | |
|---|---|---|---|---|---|---|---|---|---|---|---|
| 4.25990 | 2.91647 | 2.73579 | 3.15122 | 2.89450 | 2.39107 | 2.77359 | 2.97951 | 4.59777 | 3.62803 | |
| 7.45392 | 3.52256 | 1.78478 | 2.68828 | 2.52401 | 3.08516 | 2.74703 | 3.77928 | 5.43164 | 3.05174 | 28 |
| 4.24690 | 2.90347 | 2.73739 | 3.18146 | 3.09801 | 3.37887 | 2.77519 | 2.98518 | 4.58477 | 3.61503 | |
| 4.99257 | 2.49430 | 5.53849 | 4.24357 | 2.46062 | 2.41059 | 1.85853 | 4.19842 | 0.86471 | 7.45444 | 29 |
| 4.24690 | 2.90347 | 2.73739 | 3.18146 | 2.89801 | 2.37887 | 2.77519 | 2.98518 | 4.58477 | 3.61503 | |
| 7.47422 | 3.05599 | 4.94038 | 4.51202 | 4.02870 | 2.55786 | 3.45836 | 4.65170 | 5.43694 | 7.45541 | 30 |
| 4.24690 | 2.90347 | 2.73739 | 3.18146 | 2.89801 | 2.37887 | 2.77519 | 2.98518 | 4.58477 | 3.61503 | |
| 5.38175 | 3.18843 | 2.74073 | 2.65151 | 1.80800 | 3.26163 | 2.28623 | 3.94532 | 5.06649 | 4.24782 | 31 |
| 4.24690 | 2.90347 | 2.73739 | 3.18146 | 2.89801 | 2.37887 | 2.77519 | 2.98518 | 4.58477 | 3.61503 | |
| 5.04228 | 4.56608 | 7.13677 | 2.70509 | 2.56715 | 2.18673 | 2.02282 | 1.56038 | 2.19722 | 4.39376 | 32 |
| 4.24690 | 2.90347 | 2.73739 | 3.18146 | 2.89801 | 2.37887 | 2.77519 | 2.98518 | 4.58477 | 3.61503 | |
| 7.25230 | 4.00826 | 4.97345 | 3.39852 | 2.38655 | 3.58101 | 1.07213 | 3.44675 | 3.13280 | 4.50011 | 33 |

Fig. 12 cont.

| RMS | A | C | D | E | F | G | H | I | K | L |
|---|---|---|---|---|---|---|---|---|---|---|
| 19 | 2.68608 | 4.42943 | 2.78341 | 3.72545 | 3.46049 | 2.41475 | 3.69862 | 3.20418 | 2.68383 | 2.69526 |
|  | 0.65764 | 1.16744 | 1.76748 | 0.67718 | 0.70938 | 0.48576 | 0.85510 | 3.07411 | 3.65717 | 3.94536 |
|  | 2.93570 | 0.24756 | 3.47492 | 3.81796 | 5.11529 | 2.79396 | 3.41927 | 4.07411 | 3.65717 | 3.94536 |
| 20 | 3.68352 | 4.43477 | 2.77771 | 2.72330 | 3.46606 | 2.40764 | 3.72746 | 3.29352 | 2.67849 | 2.69332 |
|  | 0.24749 | 1.90193 | 2.65979 | 0.00523 | 5.25514 | 0.01565 | 4.16512 | 6.08725 | 7.41040 | 1.93249 |
|  | 6.28790 | 7.64979 | 5.02663 | 7.63788 | 1.97956 | 7.44104 | 4.76955 | 6.08725 | 7.41040 | 1.93249 |
| 21 | 3.68618 | 4.42225 | 2.77519 | 2.73123 | 3.46354 | 2.40513 | 3.72494 | 3.29354 | 2.67741 | 2.69355 |
|  | 0.00082 | 0.84033 | 9.66260 | 0.61958 | 0.77255 | 1.86633 | 0.16808 | 3.88865 | 3.94419 | 0.69355 |
|  | 3.52736 | 0.38434 | 3.67560 | 2.20264 | 7.73074 | 2.56871 | 2.95107 | 3.88865 | 3.94419 | 4.46765 |
| 22 | 2.68704 | 4.43311 | 2.77359 | 2.73026 | 3.46440 | 2.40599 | 3.72581 | 3.29440 | 2.67650 | 2.69280 |
|  | 0.05038 | 3.10457 | 5.45279 | 0.01503 | 4.20530 | 0.04755 | 0.50300 | 7.93405 | 0.05305 | 3.40250 |
|  | 4.58308 | 5.60303 | 9.48493 | 9.29896 | 3.29392 | 8.97950 | 2.78191 | 7.93405 | 9.05305 | 3.40250 |
| 23 | 2.68618 | 4.42225 | 2.77519 | 2.73123 | 3.46354 | 2.40513 | 3.72494 | 3.29354 | 2.67741 | 2.69355 |
|  | 0.00020 | 0.98603 | 9.61837 | 0.61958 | 0.77255 | 0.32814 | 0.50300 | 8.30939 | 6.61369 | 7.76186 |
|  | 4.44651 | 9.47010 | 0.30503 | 9.63089 | 8.78864 | 3.15060 | 4.17613 | 8.30939 | 6.61369 | 7.76186 |
| 24 | 2.68726 | 4.42333 | 2.77688 | 2.73069 | 3.46462 | 2.40621 | 3.72603 | 3.29462 | 2.67615 | 2.69463 |
|  | 0.06270 | 2.90826 | 4.92155 | 0.01204 | 4.42540 | 0.32814 | 0.50300 | 3.29462 | 2.67615 | 2.69463 |
|  | 0.86555 | 0.42542 | 3.71164 | 2.53925 | 7.77174 | 2.37470 | 4.13065 | 4.34033 | 3.04854 | 3.72523 |

| Num | A | C | D | E | F | G | H | I | K | L |
|---|---|---|---|---|---|---|---|---|---|---|
| 25 | 2.68618 | 4.42225 | 2.77519 | 2.73123 | 3.46354 | 2.40513 | 3.72494 | 3.29354 | 2.67741 | 2.69355 |
|  | 0.00425 | 0.88878 | 5.43663 | 0.61958 | 0.77255 | 0.50270 | 0.92860 | 4.94050 | 4.48349 | 1.95016 |
|  | 1.47112 | 4.69303 | 3.69763 | 3.32547 | 2.90787 | 3.40930 | 9.62065 | 3.29354 | 2.67741 | 2.69355 |
| 26 | 2.68618 | 4.42225 | 2.77519 | 2.73123 | 3.46354 | 2.40513 | 3.72494 | 3.29354 | 2.67741 | 2.69355 |
|  | 0.00020 | 0.89151 | 9.61386 | 0.61958 | 0.77255 | 0.19403 | 1.73520 | 4.78328 | 4.78829 | 6.74212 |
|  | 3.80056 | 8.43640 | 2.35718 | 4.21854 | 5.43211 | 0.56996 | 2.41889 | 3.29354 | 2.67741 | 2.69355 |
| 27 | 2.68618 | 4.42225 | 2.77519 | 2.73123 | 3.46354 | 2.40513 | 3.72494 | 3.29354 | 2.67741 | 2.69355 |
|  | 0.00020 | 0.90003 | 2.28536 | 0.61958 | 0.77255 | 0.48576 | 0.95510 | 4.64789 | 3.80057 | 3.15495 |
|  | 4.30545 | 8.41149 | 7.50830 | 4.72049 | 4.60784 | 6.70357 | 9.75810 | 3.29719 | 3.80057 | 3.15495 |
| 28 | 2.68618 | 4.42590 | 2.77805 | 2.73488 | 3.46719 | 2.40878 | 3.72860 | 3.29719 | 2.67746 | 2.68287 |
|  | 0.17635 | 2.81445 | 2.28536 | 1.09382 | 0.40787 | 0.48576 | 0.04142 | 2.59113 | 3.51153 | 0.97738 |
|  | 4.96448 | 4.83811 | 7.50830 | 3.97030 | 6.56891 | 7.11107 | 7.26866 | 3.29354 | 2.67741 | 2.69355 |
| 29 | 2.68618 | 4.42225 | 2.77519 | 2.73123 | 3.46354 | 2.40513 | 3.72494 | 3.29354 | 2.67741 | 2.69355 |
|  | 0.01635 | 0.79281 | 4.13124 | 0.61958 | 0.77255 | 3.20466 | 0.04142 | 2.84284 | 4.49239 | 2.29930 |
|  | 2.90561 | 5.75756 | 7.07935 | 3.89949 | 6.66529 | 5.36659 | 7.26866 | 3.29864 | 2.66408 | 2.69865 |
| 30 | 2.69128 | 4.37193 | 2.78029 | 2.72588 | 3.46864 | 2.40366 | 3.73004 | 3.29864 | 2.66408 | 2.69865 |
|  | 0.07854 | 2.64423 | 5.40938 | 1.37985 | 0.28984 | 2.94411 | 0.05409 | 3.29864 | 2.66408 | 2.69865 |
|  | 1.85275 | 8.31493 | 2.82194 | 2.09388 | 7.66138 | 2.77211 | 3.99780 | 5.37805 | 2.90392 | 4.36165 |

| x | w | q | O | R | S | T | V | W | Z | |
|---|---|---|---|---|---|---|---|---|---|---|
| 4.24690 | 2.90347 | 2.73739 | 3.18146 | 2.89801 | 2.37887 | 2.77519 | 2.98510 | 4.58477 | 3.61503 | |
| 3.85137 | 3.56112 | 3.81734 | 1.90773 | 2.73774 | 2.81062 | 3.21101 | 4.90862 | 3.77358 | 4.65223 | 45 |
| 4.24690 | 2.90347 | 2.73739 | 3.18146 | 2.89801 | 2.37887 | 2.77519 | 2.98510 | 4.58477 | 3.61503 | 46 |
| 7.47679 | 2.31491 | 7.09009 | 4.41050 | 3.44941 | 3.66613 | 4.22488 | 4.83925 | 8.06845 | 7.45684 | 47 |
| 4.24690 | 2.90347 | 2.73739 | 3.18146 | 2.89801 | 2.37887 | 2.77519 | 2.98510 | 4.58477 | 3.61503 | |
| 4.34475 | 1.65507 | 7.09679 | 2.31597 | 0.73626 | 3.94992 | 4.62626 | 6.79652 | 3.47904 | 4.22417 | |
| 4.25055 | 2.90712 | 2.73698 | 3.18511 | 2.89737 | 2.38252 | 2.77453 | 2.96650 | 4.58042 | 3.61868 | 51 |
| 3.15357 | 4.26605 | 2.51020 | 3.75646 | 1.99534 | 4.13172 | 5.08248 | 1.82718 | 8.07928 | 6.88925 | 52 |
| 4.24690 | 2.90347 | 2.73739 | 3.18146 | 2.89801 | 2.37887 | 2.77519 | 2.98510 | 4.58477 | 3.61503 | |
| 4.03379 | 3.93233 | 7.36760 | 3.18761 | 3.08651 | 3.41562 | 0.69273 | 2.12683 | 8.14530 | 6.93398 | 52 |
| 4.25200 | 2.90857 | 2.74249 | 9.17236 | 2.89077 | 2.38397 | 2.78029 | 2.97859 | 4.58987 | 3.62013 | |
| 5.48505 | 5.19827 | 3.41344 | 2.45435 | 2.93065 | 2.05014 | 2.01342 | 2.78633 | 6.74679 | 7.33501 | 57 |

| IDX | A | C | D | E | F | G | H | I | K | L |
|---|---|---|---|---|---|---|---|---|---|---|
| 31 | 2.68618 | 4.42225 | 2.77519 | 2.73123 | 3.46354 | 2.40513 | 3.72494 | 3.29354 | 2.67741 | 2.69355 |
| | 0.00023 | 8.77464 | 9.49698 | 0.61958 | 0.77255 | 0.12146 | 2.16827 | 1.73915 | 3.78102 | 1.62308 |
| | 3.01574 | 7.86258 | 7.16780 | 2.45829 | 6.78174 | 7.09602 | 3.94717 | | | |
| 32 | 2.69010 | 4.43564 | 2.78064 | 2.73374 | 3.47693 | 2.40837 | 3.69433 | 3.29326 | 2.68513 | 2.68690 |
| | 0.27743 | 1.56893 | 3.38122 | 1.16539 | 0.37341 | 0.13367 | 1.91344 | | | |
| | 2.56063 | 8.39754 | 3.37255 | 4.45487 | 7.74117 | 2.83358 | 3.18257 | | | |
| 33 | 2.68618 | 4.42225 | 2.77519 | 2.73123 | 3.46354 | 2.40513 | 3.72494 | 3.29354 | 2.67741 | 2.69355 |
| | 0.00550 | 0.86591 | 5.23113 | 0.61958 | 0.77255 | 2.22155 | 0.11470 | | | |
| | 3.32787 | 0.39624 | 1.20247 | 2.92792 | 5.02761 | 3.39828 | 4.50013 | | | |
| 34 | 2.68618 | 4.42225 | 2.77519 | 2.73123 | 3.46354 | 2.40513 | 3.72494 | 3.29354 | 4.47091 | 5.32186 |
| | 0.00021 | 0.86062 | 9.58296 | 0.61958 | 0.77255 | 2.33958 | 0.10133 | | | |
| | 1.67843 | 0.30775 | 4.52359 | 2.85321 | 4.43852 | 2.05297 | 4.29059 | | | |
| 35 | 2.68618 | 4.42225 | 2.77519 | 2.73123 | 3.46354 | 2.40513 | 3.72494 | 3.29354 | 2.67741 | 2.69355 |
| | 2.45080 | 0.86063 | 9.58296 | 0.61958 | 0.77255 | 2.23958 | 0.10133 | | | |
| | | 0.38775 | 1.55725 | 2.73976 | 4.13082 | 1.98019 | 6.84466 | 7.23156 | 3.22344 | 3.08013 |
| 36 | 2.68618 | 4.42225 | 2.77519 | 2.73123 | 3.46354 | 2.40513 | 3.72494 | 3.29354 | 2.67741 | 2.69355 |
| | 0.08713 | 0.86062 | 2.48531 | 0.61958 | 0.77255 | 0.18826 | 1.76260 | | | |
| | 3.11994 | 0.35051 | 4.02382 | 4.31796 | 7.69698 | 0.45237 | 4.14501 | 7.18394 | 3.74035 | 5.27099 |

Fig. 12 cont.

| | x | z | p | q | R | s | t | u | v | w | x |
|---|---|---|---|---|---|---|---|---|---|---|---|
| | 4.24690 | 2.90347 | 2.73739 | 3.18146 | 2.89801 | 2.37887 | 2.77519 | 2.98518 | 4.58477 | 3.61503 | 58 |
| | 3.55462 | 6.93057 | 3.29479 | 3.92211 | 2.59793 | 2.80988 | 2.76476 | 2.92147 | 0.25967 | 4.10984 | 64 |
| | 4.25107 | 2.91394 | 2.74546 | 3.18313 | 2.90617 | 2.38810 | 2.74236 | 2.97283 | 4.58816 | 3.58066 | 65 |
| | 7.43858 | 4.86067 | 5.13483 | 3.65285 | 2.93570 | 3.23345 | 0.80640 | 2.71579 | 0.83109 | 4.72271 | |
| | 4.24690 | 2.90347 | 2.73739 | 3.18146 | 2.89801 | 2.37887 | 2.77519 | 2.98518 | 4.58477 | 3.61503 | 66 |
| | 4.78102 | 2.30551 | 7.05181 | 3.83173 | 2.41888 | 2.90094 | 2.28200 | 3.33158 | 0.82870 | 2.32377 | |
| | 4.24690 | 2.90347 | 2.73739 | 3.18146 | 2.89801 | 2.37887 | 2.77519 | 2.98518 | 4.58477 | 3.61503 | 67 |
| | 7.42938 | 4.07152 | 1.11440 | 5.94579 | 3.05039 | 3.61819 | 2.09385 | 4.49636 | 4.45321 | 7.41386 | |
| | 4.24690 | 2.90347 | 2.73739 | 3.18146 | 2.89801 | 2.37887 | 2.77519 | 2.98518 | 4.58477 | 3.61503 | 68 |
| | 7.43854 | 2.75847 | 7.05124 | 2.60431 | 2.98280 | 2.08670 | 2.76732 | 4.51052 | 0.83012 | 4.72142 | |
| | 4.24690 | 2.90347 | 2.73739 | 3.18146 | 2.89801 | 2.37887 | 2.77519 | 2.98518 | 4.58477 | 3.61503 | |
| | 7.39081 | 4.31542 | 4.92795 | 3.81429 | 3.75508 | 2.95443 | 3.46098 | 6.74190 | 0.78235 | 2.99325 | |

Fig. 12 cont.

| RDX | A | C | D | E | F | G | H | I | K | L |
|---|---|---|---|---|---|---|---|---|---|---|
| 37 | 2.68618 | 4.42225 | 2.77519 | 2.73123 | 3.46354 | 2.40513 | 3.72494 | 3.29354 | 2.67741 | 2.69355 |
|  | 0.00283 | 8.91107 | 5.60709 | 0.61958 | 0.77255 | 1.86571 | 0.16816 | 4.21016 | 2.63905 | 2.70790 |
|  | 2.26606 | 8.35678 | 3.11226 | 2.24186 | 4.50323 | 3.10679 | 4.10785 |  |  |  |
|  | 2.68557 | 4.42349 | 2.77443 | 2.73247 | 3.46470 | 2.40452 | 3.71149 | 3.29478 | 2.67865 | 2.69479 |
|  | 0.04638 | 3.05428 | 3.54058 | 0.34490 | 1.23301 | 0.03275 | 3.43509 | 2.63191 | 2.97085 | 3.42828 |
|  | 1.04999 | 8.43034 | 4.36699 | 2.34863 | 7.77381 | 5.18071 | 4.70557 |  |  |  |
| 38 | 2.68618 | 4.42225 | 2.77519 | 2.73123 | 3.46354 | 2.40513 | 3.72494 | 3.29354 | 2.67741 | 2.69355 |
|  | 0.00014 | 0.89936 | * | 0.61958 | 0.77255 | 0.00000 | * |  |  |  |

Fig. 12 cont.

| x | x | a | b | c | d | e | f | 69 | 72 |
|---|---|---|---|---|---|---|---|---|---|
| 4.24690 | 2.80347 | 2.73739 | 3.18146 | 2.89801 | 2.37887 | 2.77519 | 2.98518 | 4.58477 | 3.61503 |
| 7.39713 | 3.11935 | 3.92420 | 3.34502 | 3.00430 | 2.39493 | 2.00120 | 2.97087 | 8.79876 | 4.86137 |
| 4.24814 | 2.80470 | 2.73863 | 3.18270 | 2.89925 | 2.37871 | 2.77643 | 2.97732 | 4.58601 | 3.61627 |
| 4.10051 | 4.27453 | 4.29539 | 3.38993 | 3.87057 | 3.41823 | 1.33358 | 2.10091 | 8.86399 | 4.96167 |
| 4.24690 | 2.80347 | 2.73739 | 3.18146 | 2.89801 | 2.37887 | 2.77519 | 2.98518 | 4.58477 | 3.61503 |

Fig. 12 cont.

```
HMMER3/b [3.0 | March 2010]
NAME  TIGR01643
ACC   TIGR01643
DESC  YD_repeat_2x: YD repeat (two copies)
LENG  42
ALPH  amino
RF    no
CS    no
MAP   yes
DATE  Sun Apr 11 22:11:14 2010
NSEQ  25
EFFN  25.000000
CKSUM 1747993535
GA    15.80 15.80;
TC    15.80 15.80;
NC    10.10 10.10;
STATS LOCAL MSV       -7.6099  0.72733
STATS LOCAL VITERBI   -8.0866  0.72733
STATS LOCAL FORWARD   -3.5163  0.72733
```

Fig. 13

| RXN | A m->m | C m->i | D m->d | E i->m | F i->i | G d->m | H d->d | I | K | L |
|---|---|---|---|---|---|---|---|---|---|---|
| COMPO | 2.50864 | 5.00599 | 2.47079 | 2.74610 | 3.87961 | 2.55470 | 3.42380 | 3.27701 | 3.08211 | 2.65210 |
| | 2.68618 | 4.42225 | 2.77519 | 2.73123 | 3.46354 | 2.40513 | 3.72494 | 3.29354 | 2.67741 | 2.69355 |
| 1 | 0.00160 | 6.83446 | 7.55680 | 0.61958 | 0.77255 | 0.00000 | 0.95510 | 6.33210 | 6.59798 | 5.51337 |
| | 6.56434 | 3.98469 | 3.02655 | 7.02507 | 4.27282 | 7.06523 | 2.16044 | 3.29354 | 2.67741 | 2.69355 |
| 2 | 2.68618 | 4.42225 | 2.77519 | 2.73123 | 3.46354 | 2.40513 | 3.72494 | 7.35370 | 5.59063 | 6.76133 |
| | 0.00160 | 6.83446 | 7.55680 | 0.61958 | 0.77255 | 0.48576 | 0.95510 | 3.29354 | 2.67741 | 2.69355 |
| 3 | 5.53079 | 8.30014 | 0.60641 | 4.36877 | 7.66559 | 2.62579 | 6.27460 | 5.38062 | 2.90569 | 3.25594 |
| | 2.68618 | 4.42225 | 2.77519 | 2.73123 | 3.46354 | 2.40513 | 3.72494 | 3.29354 | 2.67741 | 2.69355 |
| 4 | 0.00160 | 6.83446 | 7.55680 | 0.61958 | 0.77255 | 0.48576 | 0.95510 | 4.94490 | 2.67676 | 2.73327 |
| | 1.41461 | 6.54788 | 2.06221 | 2.71794 | 5.69390 | 2.67676 | 4.99490 | 3.25502 | 3.74787 | 2.73327 |
| 5 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 5.54831 | 4.06734 | 5.05867 |
| 6 | 1.73177 | 3.40977 | 2.55808 | 2.92033 | 6.01963 | 0.74196 | 2.74856 | 3.29354 | 2.67741 | 2.69355 |
| | 2.68618 | 4.42225 | 2.77519 | 2.73123 | 3.46354 | 2.40513 | 3.72494 | 3.29354 | 2.67741 | 2.69355 |
| | 0.04483 | 6.83446 | 3.15199 | 0.61958 | 0.77255 | 0.48576 | 0.95510 | 3.25265 | 2.49314 | 2.96602 |
| | 2.49835 | 6.51919 | 3.04441 | 2.93564 | 5.86634 | 4.77817 | 3.19919 | | | |

| | A | C | D | E | F | G | H | I | K | L |
|---|---|---|---|---|---|---|---|---|---|---|
| 7 | 2.68618 | 4.42225 | 2.77519 | 2.73123 | 3.46354 | 2.40513 | 3.72494 | 3.29354 | 2.67741 | 2.69355 |
| | 0.00167 | 6.79129 | 7.51364 | 0.61958 | 0.77255 | 0.24896 | 1.51237 | 2.39056 | 5.79381 | 0.70297 |
| | 4.59226 | 5.92803 | 6.56878 | 3.20146 | 5.03101 | 5.03599 | 6.21567 | 2.39056 | 5.79381 | 0.70297 |
| 8 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 1.61863 | 5.75321 | 1.75734 |
| | 2.59623 | 5.07030 | 6.53673 | 5.94636 | 5.03929 | 5.78147 | 6.16501 | 1.61863 | 5.75321 | 1.75734 |
| 9 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 5.37916 | 2.90491 | 3.23485 |
| | 1.36404 | 6.54609 | 3.13208 | 3.63210 | 5.89235 | 1.57340 | 3.25314 | 5.37916 | 2.90491 | 3.23485 |
| 10 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 2.70335 | 3.05705 | 2.90478 |
| | 3.18920 | 6.16156 | 3.13208 | 3.21085 | 3.33723 | 4.93464 | 3.07006 | 2.70335 | 3.05705 | 2.90478 |
| 11 | 2.68618 | 4.42225 | 2.77519 | 2.73123 | 3.46354 | 2.40513 | 3.72494 | 3.29354 | 2.67741 | 2.69355 |
| | 4.03916 | 6.47463 | 3.16106 | 2.95208 | 3.36208 | 4.82507 | 2.53363 | 2.65910 | 2.15180 | 3.09364 |
| 12 | 3.07046 | 6.57107 | 1.34923 | 2.15196 | 5.91620 | 4.82141 | 2.61614 | 5.40344 | 9.75280 | 2.71685 |

Fig. 13 cont.

| | M | N | P | Q | R | S | T | V | W | X |
|---|---|---|---|---|---|---|---|---|---|---|
| | 4.24690 | 2.90347 | 2.73739 | 3.18146 | 2.89801 | 2.37887 | 2.77519 | 2.98518 | 4.58477 | 3.61503 |
| 7 | 4.97841 | 5.99737 | 1.94852 | 5.93162 | 5.02012 | 5.16432 | 3.19142 | 3.00777 | 6.67757 | 5.50721 |
| | 4.24690 | 2.90347 | 2.73739 | 3.18146 | 2.89801 | 2.37887 | 2.77519 | 2.98518 | 4.58477 | 3.61503 |
| 8 | 4.99636 | 5.94860 | 6.12534 | 3.29179 | 5.77767 | 5.10942 | 1.31840 | 1.59962 | 6.63959 | 5.45880 |
| | 4.24690 | 2.90347 | 2.73739 | 3.18146 | 2.89801 | 2.37887 | 2.77519 | 2.98518 | 4.58477 | 3.61503 |
| 9 | 5.58644 | 4.27297 | 5.19946 | 3.10750 | 2.64805 | 1.91155 | 2.21394 | 4.93737 | 6.97805 | 5.56638 |
| | 4.24690 | 2.90347 | 2.73739 | 3.18146 | 2.89801 | 2.37887 | 2.77519 | 2.98518 | 4.58477 | 3.61503 |
| 10 | 5.24136 | 4.49856 | 5.32258 | 4.32565 | 3.05303 | 1.90993 | 2.50767 | 1.99402 | 6.68615 | 2.33950 |
| | 4.24690 | 2.90347 | 2.73739 | 3.18146 | 2.89801 | 2.37887 | 2.77519 | 2.98518 | 4.58477 | 3.61503 |
| 11 | 5.52336 | 3.09827 | 5.21778 | 4.12255 | 2.25309 | 2.32808 | 1.50785 | 0.56946 | 6.92506 | 5.53393 |
| | 4.24690 | 2.90347 | 2.73739 | 3.18146 | 2.89801 | 2.37887 | 2.77519 | 2.98518 | 4.58477 | 3.61503 |
| 12 | 5.61236 | 1.81040 | 5.21924 | 2.97522 | 4.24727 | 2.81132 | 2.43060 | 4.96184 | 7.00316 | 5.59014 |

Fig. 13 cont.

| RDX | A | C | D | E | F | G | H | I | K | L |
|---|---|---|---|---|---|---|---|---|---|---|
| 13 | 2.68618 0.00160 1.49586 | 4.42225 6.83446 6.54814 | 2.77519 7.56680 2.92195 | 2.73123 0.61958 3.46231 | 3.46354 0.77255 5.69398 | 2.40513 0.48576 3.14767 | 3.72494 0.95510 4.99560 | 3.29354 5.38060 | 2.67741 3.73040 | 2.69355 4.85378 |
| 14 | 2.68618 0.00160 2.58810 | 4.42225 6.83446 6.54586 | 2.77519 7.56680 1.62253 | 2.73123 0.61958 2.42852 | 3.46354 0.77255 3.37356 | 2.40513 0.48576 2.03753 | 3.72494 0.95510 3.29100 | 3.29354 5.37887 | 2.67741 3.72704 | 2.69355 3.20893 |
| 15 | 2.68618 0.00160 2.58814 | 4.42225 6.83446 6.45006 | 2.77519 7.56680 4.33979 | 2.73123 0.61958 3.78237 | 3.46354 0.77255 5.75486 | 2.40513 0.48576 0.72002 | 3.72494 0.95510 3.29378 | 3.29354 5.21220 | 2.67741 3.78054 | 2.69355 4.73831 |
| 16 | 2.68618 0.16471 2.94233 | 4.42225 6.83446 6.39655 | 2.77519 7.56680 4.15885 | 2.73123 0.61958 2.11511 | 3.46354 0.77255 3.22930 | 2.40513 0.48576 4.67975 | 3.72494 0.95510 3.00387 | 3.29354 3.08338 | 2.67741 2.74999 | 2.69355 4.69873 |
| 17 | 2.68618 0.00160 2.52006 | 4.42225 6.83446 6.53128 | 2.77519 7.56680 2.61474 | 2.73123 0.61958 2.72011 | 3.46354 0.77255 3.50688 | 2.40513 0.48576 4.80961 | 3.72494 0.95510 4.98708 | 3.29354 3.29354 | 2.67741 2.88086 | 2.69355 3.34558 |
| 18 | 2.68618 0.00188 4.17706 | 4.42225 6.83446 6.67160 | 2.77519 7.56680 7.29397 | 2.73123 0.61958 1.89189 | 3.46354 0.77255 1.98074 | 2.40513 0.48576 0.11130 | 3.72494 0.95510 2.25070 | 3.29354 2.67508 | 2.67741 5.00126 | 2.69355 2.37292 |
| 19 | 2.68618 0.00160 2.52006 | 4.42225 6.83446 6.53128 | 2.77519 7.56680 4.28693 | 2.73123 0.61958 3.16799 | 3.46354 0.77255 4.79227 | 2.40513 0.48576 5.29310 | 3.72494 0.95510 2.02541 | 3.29354 3.01170 | 2.67741 2.67741 | 2.69355 2.69355 |
| 20 | 2.68618 0.00160 4.25533 | 4.42225 6.83446 5.62513 | 2.77519 7.56680 6.22660 | 2.73123 0.61958 5.61413 | 3.46354 0.77255 1.98074 | 2.40513 0.48576 5.42449 | 3.72494 0.95510 5.73261 | 3.29354 4.04245 | 2.67741 5.39628 | 2.69355 1.55796 |
| 21 | 2.68618 0.00160 2.44992 | 4.42225 6.83446 6.54600 | 2.77519 7.56680 2.21430 | 2.73123 0.61958 2.08531 | 3.46354 0.77255 3.89230 | 2.40513 0.48576 3.22557 | 3.72494 0.95510 4.99271 | 3.29354 5.37915 | 2.67741 2.44734 | 2.69355 4.85181 |
| 22 | 2.68618 0.00160 6.96708 | 4.42225 6.83446 3.22983 | 2.77519 7.56680 7.69264 | 2.73123 0.61958 7.67802 | 3.46354 0.77255 4.26980 | 2.40513 0.48576 7.28659 | 3.72494 0.95510 5.87136 | 3.29354 6.59295 | 2.67741 7.15368 | 2.69355 5.64553 |

Fig. 13 cont.

| | N | M | P | Q | R | S | T | V | W | Y | |
|---|---|---|---|---|---|---|---|---|---|---|---|
| | 4.24690 | 2.90347 | 2.73739 | 3.18146 | 2.89801 | 2.37887 | 2.77519 | 2.98518 | 4.58477 | 3.61503 | |
| 13 | 5.58872 | 3.09039 | 1.63516 | 3.01701 | 2.20693 | 3.99718 | 2.50536 | 3.25223 | 6.98037 | 5.56876 | |
| | 4.24690 | 2.90347 | 2.73739 | 3.18146 | 2.89801 | 2.37887 | 2.77519 | 2.98518 | 4.58477 | 3.61503 | |
| 14 | 5.58621 | 3.12059 | 3.21180 | 2.83601 | 3.05943 | 2.17492 | 3.04417 | 4.93711 | 6.97785 | 5.56620 | |
| | 4.24690 | 2.90347 | 2.73739 | 3.18146 | 2.89801 | 2.37887 | 2.77519 | 2.98518 | 4.58477 | 3.61503 | |
| 15 | 3.24433 | 2.99251 | 5.22946 | 3.15349 | 3.07738 | 3.00649 | 3.02615 | 4.61920 | 3.50254 | 5.52539 | |
| | 4.24690 | 2.90347 | 2.73739 | 3.18146 | 2.89801 | 2.37887 | 2.77519 | 2.98518 | 4.58477 | 3.61503 | |
| 16 | 5.43912 | 2.48618 | 5.07305 | 2.14018 | 2.11790 | 2.92098 | 2.14276 | 3.11671 | 3.20918 | 5.42708 | |
| | 4.24690 | 2.90347 | 2.73739 | 3.18146 | 2.89801 | 2.37887 | 2.77519 | 2.98518 | 4.58477 | 3.61503 | |
| 17 | 5.57339 | 3.02952 | 3.16398 | 2.42450 | 2.56775 | 3.02526 | 1.76897 | 2.40310 | 6.96729 | 5.55960 | |
| | 4.24690 | 2.90347 | 2.73739 | 3.18146 | 2.89801 | 2.37887 | 2.77519 | 2.98518 | 4.58477 | 3.61503 | |
| 18 | 3.08694 | 5.30772 | 5.66147 | 3.25530 | 3.31784 | 3.13078 | 1.42653 | 2.55966 | 2.74421 | 2.44259 | |
| | 4.24690 | 2.90347 | 2.73739 | 3.18146 | 2.89801 | 2.37887 | 2.77519 | 2.98518 | 4.58477 | 3.61503 | |
| 19 | 5.59066 | 4.27860 | 5.20470 | 2.16883 | 1.41049 | 2.95817 | 2.07809 | 4.94168 | 3.41631 | 5.57094 | |
| | 4.24690 | 2.90347 | 2.73739 | 3.18146 | 2.89801 | 2.37887 | 2.77519 | 2.98518 | 4.58477 | 3.61503 | |
| 20 | 3.08039 | 5.58639 | 5.78459 | 2.60061 | 5.39744 | 4.73729 | 3.19415 | 2.40995 | 3.37788 | 1.21140 | |
| | 4.24690 | 2.90347 | 2.73739 | 3.18146 | 2.89801 | 2.37887 | 2.77519 | 2.98518 | 4.58477 | 3.61503 | |
| 21 | 3.38413 | 3.04687 | 5.19328 | 3.09412 | 3.06653 | 2.59602 | 1.59642 | 3.34878 | 6.97794 | 3.33288 | |
| | 4.24690 | 2.90347 | 2.73739 | 3.18146 | 2.89801 | 2.37887 | 2.77519 | 2.98518 | 4.58477 | 3.61503 | |
| 22 | 7.06925 | 6.80734 | 7.55139 | 6.96950 | 3.22771 | 6.73574 | 7.16230 | 6.55349 | 1.83357 | 0.31604 | |

Fig. 13 cont.

| | A | C | D | E | F | G | H | I | K | L |
|---|---|---|---|---|---|---|---|---|---|---|
| 23 | 2.68618<br>0.00160<br>4.89770 | 4.42225<br>6.83446<br>7.11470 | 2.77519<br>7.55680<br>0.51286 | 2.73123<br>0.61958<br>4.30713 | 3.46354<br>0.77255<br>3.26487 | 2.40513<br>0.48576<br>5.35364 | 3.72494<br>0.95510<br>3.14186 | 3.29354<br>3.10457 | 3.67741<br>4.87333 | 2.69355<br>5.37359 |
| 24 | 2.68618<br>0.00160<br>1.44648 | 4.42225<br>6.83446<br>6.54765 | 2.77519<br>7.55680<br>2.57803 | 2.73123<br>0.61958<br>2.22175 | 3.46354<br>0.77255<br>5.89367 | 2.40513<br>0.48576<br>1.76619 | 3.72494<br>0.95510<br>4.99473 | 3.29354<br>5.38040 | 3.67741<br>2.87160 | 2.69355<br>3.04088 |
| 25 | 2.68618<br>0.00160<br>1.77154 | 4.42225<br>6.83446<br>6.52281 | 2.77519<br>7.55680<br>2.98691 | 2.73123<br>0.61958<br>2.47624 | 3.46354<br>0.77255<br>2.77217 | 2.40513<br>0.48576<br>4.01187 | 3.72494<br>0.95510<br>3.26310 | 3.29354<br>5.33795 | 3.67741<br>3.73831 | 2.69355<br>2.25677 |
| 26 | 2.68618<br>0.00160<br>3.16025 | 4.42225<br>6.83446<br>7.33571 | 2.77519<br>7.55680<br>2.11070 | 2.73123<br>0.61958<br>2.78851 | 3.46354<br>0.77255<br>6.66729 | 2.40513<br>0.48576<br>0.57839 | 3.72494<br>0.95510<br>3.32566 | 3.29354<br>6.18712 | 3.67741<br>2.67741 | 2.69355<br>2.69355 |
| 27 | 2.68618<br>0.00160<br>3.01251 | 4.42225<br>6.83446<br>6.54456 | 2.77519<br>7.55680<br>4.38130 | 2.73123<br>0.61958<br>3.81847 | 3.46354<br>0.77255<br>3.51104 | 2.40513<br>0.48576<br>4.87971 | 3.72494<br>0.95510<br>3.33172 | 3.29354<br>5.33764 | 3.67741<br>4.50496 | 2.69355<br>5.64578 |
| 28 | 2.68618<br>0.00160<br>4.19270 | 4.42225<br>6.83446<br>5.58076 | 2.77519<br>7.55680<br>6.05975 | 2.73123<br>0.61958<br>5.45038 | 3.46354<br>0.77255<br>4.67632 | 2.40513<br>0.48576<br>5.35113 | 3.72494<br>0.95510<br>5.67914 | 3.29354<br>2.42170 | 3.67741<br>2.12216 | 2.69355<br>2.54102 |
| 29 | 2.68618<br>0.00160<br>3.08943 | 4.42225<br>6.83446<br>5.76856 | 2.77519<br>7.55680<br>5.20211 | 2.73123<br>0.61958<br>4.62958 | 3.46354<br>0.77255<br>4.89094 | 2.40513<br>0.48576<br>3.20418 | 3.72494<br>0.95510<br>5.43618 | 3.29354<br>1.75028 | 3.67741<br>3.38121 | 2.69355<br>0.85976 |
| 30 | 2.68618<br>0.00160<br>1.77416 | 4.42225<br>6.83446<br>3.15281 | 2.77519<br>7.55680<br>4.46195 | 2.73123<br>0.61958<br>1.39994 | 3.46354<br>0.77255<br>5.86136 | 2.40513<br>0.48576<br>2.16719 | 3.72494<br>0.95510<br>5.15016 | 3.29354<br>5.32066 | 3.67741<br>2.53662 | 2.69355<br>2.40204 |
| 31 | 2.68618<br>0.00160<br>3.06584 | 4.42225<br>6.83446<br>6.40839 | 2.77519<br>7.55680<br>4.36059 | 2.73123<br>0.61958<br>1.99235 | 3.46354<br>0.77255<br>5.69644 | 2.40513<br>0.48576<br>4.84605 | 3.72494<br>0.95510<br>2.56206 | 3.29354<br>1.95191 | 3.67741<br>2.15389 | 2.69355<br>4.68808 |

Fig. 13 cont.

|   | 23 | 24 | 25 | 26 | 27 | 28 | 29 | 30 | 31 |
|---|---|---|---|---|---|---|---|---|---|
| Z | 3.61503 | 5.98801 / 3.61503 | 5.56808 / 3.61503 | 2.67600 / 3.61503 | 6.29713 / 3.61503 | 3.22847 / 3.61503 | 5.02492 / 3.61503 | 5.14629 / 3.61503 | 5.64339 / 3.61503 | 5.50333 |
| W | 4.58477 | 7.44826 / 4.58477 | 6.97976 / 4.58477 | 3.58051 / 4.58477 | 7.77772 / 4.58477 | 6.97885 / 4.58477 | 6.20311 / 4.58477 | 6.36292 / 4.58477 | 7.02033 / 4.58477 | 3.40931 |
| Y | 2.98518 | 5.45504 / 2.98518 | 4.93882 / 2.98518 | 4.90041 / 2.98518 | 5.72865 / 2.98518 | 4.92746 / 2.98518 | 2.47322 / 2.98518 | 1.70583 / 2.98518 | 3.35654 / 2.98518 | 2.53163 |
| B | 2.77519 | 2.92267 / 2.77519 | 3.18621 / 2.77519 | 4.26574 / 2.77519 | 5.00196 / 2.77519 | 4.33019 / 2.77519 | 3.12756 / 2.77519 | 1.78566 / 2.77519 | 3.11291 / 2.77519 | 3.07457 |
| S | 2.37887 | 4.87444 / 2.37887 | 3.59136 / 2.37887 | 2.42801 / 2.37887 | 2.45144 / 2.37887 | 4.07591 / 2.37887 | 2.96325 / 2.37887 | 2.41945 / 2.37887 | 1.76909 / 2.37887 | 4.04076 |
| R | 2.89801 | 5.41449 / 2.89801 | 4.22249 / 2.89801 | 3.06930 / 2.89801 | 3.26439 / 2.89801 | 1.16387 / 2.89801 | 2.01504 / 2.89801 | 3.34064 / 2.89801 | 2.46740 / 2.89801 | 2.21393 |
| O | 3.18146 | 5.04384 / 3.18146 | 2.50859 / 3.18146 | 1.92520 / 3.18146 | 4.74463 / 3.18146 | 2.25634 / 3.18146 | 5.40462 / 3.18146 | 3.20202 / 3.18146 | 4.26518 / 3.18146 | 2.24460 |
| P | 2.73739 | 5.92586 / 2.73739 | 3.04850 / 2.73739 | 5.20512 / 2.73739 | 5.74406 / 2.73739 | 5.26987 / 2.73739 | 3.41784 / 2.73739 | 5.54434 / 2.73739 | 5.30770 / 2.73739 | 5.23788 |
| M | 2.90347 | 1.08110 / 2.90347 | 4.27431 / 2.90347 | 3.12323 / 2.90347 | 4.65937 / 2.90347 | 2.00581 / 2.90347 | 5.48095 / 2.90347 | 4.98193 / 2.90347 | 4.43440 / 2.90347 | 4.34022 |
| N | 4.24690 | 6.25806 / 4.24690 | 5.58014 / 4.24690 | 5.56593 / 4.24690 | 6.42785 / 4.24690 | 4.59206 / 4.24690 | 5.03978 / 4.24690 | 4.87677 / 4.24690 | 5.61391 / 4.24690 | 3.41315 |

Fig. 13 cont.

| RRN | A | C | D | E | F | G | H | I | K | L |
|---|---|---|---|---|---|---|---|---|---|---|
| | 2.68618 | 4.42225 | 2.77519 | 2.73123 | 3.46354 | 2.40513 | 3.72494 | 3.29354 | 2.67741 | 2.69355 |
| 32 | 0.00160 | 6.83446 | 7.55680 | 0.61958 | 0.77255 | 0.48576 | 0.95510 | 3.29354 | 2.67741 | 2.69355 |
| | 3.07788 | 6.24111 | 3.09476 | 2.96303 | 3.06607 | 4.90231 | 2.36917 | 3.34786 | 3.91543 | 3.13014 |
| 33 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 3.01168 | 5.69859 | 1.29277 | 4.08274 | 3.32425 | 5.23654 | 3.32991 | 2.98773 | 4.78725 | 2.19235 |
| 34 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 1.77047 | 6.21722 | 4.50206 | 3.94434 | 3.24425 | 2.40513 | 3.72494 | 3.29354 | 3.93504 | 2.55734 |
| 35 | 2.68618 | 4.42225 | 2.77519 | 2.73123 | 3.46354 | 2.40513 | 5.11970 | 3.24610 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 2.56582 | 6.53868 | 1.37204 | 2.87844 | 5.88161 | 4.91212 | 4.99496 | 3.26374 | 2.44700 | 2.76267 |
| 36 | 2.68618 | 4.42225 | 2.77519 | 2.73123 | 3.46354 | 2.38843 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 0.13827 | 4.54389 | 2.56239 | 2.71849 | 5.88834 | 1.03692 | 3.07095 | 3.31963 | 2.97303 | 4.84891 |
| 37 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 3.92264 | 6.54046 | 3.05083 | 2.92710 | 5.78280 | 1.87045 | 2.12434 | 3.33946 | 2.44700 | 2.76267 |
| 38 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 2.52221 | 4.69803 | 4.42037 | 2.92710 | 5.62725 | 2.40513 | 5.05809 | 3.33946 | 2.32591 | 3.00124 |
| 39 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 2.63673 | 3.35786 | 4.39357 | 2.91160 | 5.62725 | 1.87045 | 3.72494 | 2.56797 | 2.13027 | 2.58580 |
| 40 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 4.07020 | 4.69803 | 4.28312 | 2.47893 | 3.17983 | 4.91482 | 2.39295 | 4.84419 | 2.98932 | 2.91927 |
| 41 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 2.53395 | 3.07855 | 6.17152 | 2.00931 | 3.17983 | 2.94418 | 5.69948 | 3.39159 | 2.17330 | 3.26224 |
| 42 | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 4.19470 | 3.07855 | 2.58011 | 5.55524 | 2.01313 | 5.36537 | 5.12236 | 2.77190 | 3.90533 | 1.85612 |
| | 2.68618 | 4.42225 | 2.77519 | 2.73123 | 3.46354 | 2.40513 | 3.72494 | 3.29354 | 2.67741 | 2.69355 |
| | 0.00160 | 6.83446 | 7.55680 | 0.61958 | 0.77255 | 0.48576 | 0.95510 | 3.29354 | 2.67741 | 2.69355 |
| | 2.14657 | 6.54374 | 6.17152 | 1.54404 | 5.88900 | 4.80637 | 5.06279 | 5.37510 | 2.98158 | 3.23428 |
| | 0.00108 | 6.83393 | 2.77519 | 2.73123 | 3.46354 | 0.00000 | 3.72494 | 3.29354 | 2.67741 | 2.69355 |

Fig. 13 cont.

| | M | N | P | Q | R | S | Z | A | W | Y | |
|---|---|---|---|---|---|---|---|---|---|---|---|
| | 4.24690 | 2.90347 | 2.73739 | 3.18146 | 2.89801 | 2.37887 | 2.77519 | 2.98518 | 4.58477 | 3.61503 | |
| 32 | 5.31384 | 2.58593 | 5.29172 | 4.26367 | 2.27613 | 4.10655 | 1.10340 | 3.14721 | 6.74871 | 5.41927 | |
| | 4.24690 | 2.90347 | 2.73739 | 3.18146 | 2.89801 | 2.37887 | 2.77519 | 2.98518 | 4.58477 | 3.61503 | |
| 33 | 3.13924 | 3.37248 | 5.60846 | 5.03231 | 2.43691 | 2.63744 | 2.61964 | 2.97784 | 3.27312 | 5.09446 | |
| | 4.24690 | 2.90347 | 2.73739 | 3.18146 | 2.89801 | 2.37887 | 2.77519 | 2.98518 | 4.58477 | 3.61503 | |
| 34 | 5.29227 | 2.30294 | 1.89023 | 2.87763 | 2.53864 | 2.86865 | 1.91925 | 4.54106 | 6.73016 | 3.29342 | |
| | 4.24690 | 2.90347 | 2.73739 | 3.18146 | 2.89801 | 2.37887 | 2.77519 | 2.98518 | 4.58477 | 3.61503 | |
| 35 | 3.12917 | 2.80289 | 5.20110 | 2.57516 | 3.18610 | 3.99639 | 3.15537 | 4.92817 | 3.40638 | 5.56299 | |
| | 4.24690 | 2.90347 | 2.73739 | 3.18146 | 2.89801 | 2.37887 | 2.77519 | 2.98518 | 4.58477 | 3.61503 | |
| 36 | 5.58479 | 3.00948 | 5.20178 | 4.09214 | 2.31134 | 2.51618 | 4.26580 | 3.17060 | 6.97694 | 5.56028 | |
| | 4.24690 | 2.90347 | 2.73739 | 3.18146 | 2.89801 | 2.37887 | 2.77519 | 2.98518 | 4.58477 | 3.61503 | |
| 37 | 5.47871 | 2.51457 | 5.21573 | 2.11179 | 2.06618 | 2.41420 | 4.15379 | 4.82775 | 6.86028 | 5.45654 | |
| | 4.24690 | 2.90347 | 2.73739 | 3.18146 | 2.89801 | 2.37887 | 2.77519 | 2.98518 | 4.58477 | 3.61503 | |
| 38 | 5.41930 | 4.36761 | 5.25295 | 3.11492 | 2.08200 | 1.91055 | 2.02375 | 2.35815 | 6.83056 | 5.47869 | |
| | 4.24690 | 2.90347 | 2.73739 | 3.18146 | 2.89801 | 2.37887 | 2.77519 | 2.98518 | 4.58477 | 3.61503 | |
| 39 | 5.28906 | 4.46127 | 5.30365 | 2.49296 | 2.67115 | 2.52641 | 1.21996 | 2.04180 | 3.32052 | 5.40549 | |
| | 4.24690 | 2.90347 | 2.73739 | 3.18146 | 2.89801 | 2.37887 | 2.77519 | 2.98518 | 4.58477 | 3.61503 | |
| 40 | 5.50148 | 4.27534 | 5.20078 | 2.17546 | 1.95117 | 1.94327 | 3.00647 | 4.93038 | 6.97395 | 3.20447 | |
| | 4.24690 | 2.90347 | 2.73739 | 3.18146 | 2.89801 | 2.37887 | 2.77519 | 2.98518 | 4.58477 | 3.61503 | |
| 41 | 4.68653 | 5.53208 | 5.72894 | 3.53647 | 5.34054 | 4.67721 | 1.95786 | 2.44597 | 2.72945 | 1.69928 | |
| | 4.24690 | 2.90347 | 2.73739 | 3.18146 | 2.89801 | 2.37887 | 2.77519 | 2.98518 | 4.58477 | 3.61503 | |
| 42 | 5.50435 | 3.12083 | 5.19924 | 3.01669 | 2.96758 | 3.99487 | 1.77550 | 3.27316 | 3.69765 | 3.33270 | |
| | 4.24690 | 2.90347 | 2.73739 | 3.18146 | 2.89801 | 2.37887 | 2.77519 | 2.98518 | 4.58477 | 3.61503 | |

Fig. 13 cont.

```
HMMER3/e [3.1dev | November 2011]
NAME  jackhammer
LENG  38
ALPH  amino
RF    yes
CONS  yes
CS    no
MAP   yes
DATE  Tue Apr 16 21:28:55 2013
NSEQ  39112
EFFN  49.343384
CKSUM 539835657
STATS LOCAL MSV      -7.8781  0.71955
STATS LOCAL VITERBI  -8.0909  0.71955
STATS LOCAL FORWARD  -3.6623  0.71955
```

Fig. 14

| COMPO | A m->m | C m->i | D m->d | E i->m | F i->i | G d->m | H d->d | I | K | L |
|---|---|---|---|---|---|---|---|---|---|---|
| 1 x n x | 2.58290 2.68018 7.548995 | 5.09664 4.422225 7.166626 | 2.48174 2.775519 7.808861 | 2.953364 2.731123 0.619958 | 3.99389 3.463554 0.772255 | 2.341163 2.405513 0.000000 | 3.89546 3.72494 * | 3.41057 3.29354 7.09673 | 3.13020 2.67741 7.96339 | 2.72790 2.69355 6.12310 |
| 2 x D x | 2.68018 0.001115 0.101191 | 4.422225 7.166626 9.206669 | 2.775519 7.537802 0.154178 | 2.731123 0.619958 8.177282 | 3.463554 0.772255 4.772057 | 2.405513 0.488376 7.687716 | 3.72494 0.985510 6.334431 | 3.29354 7.91150 | 2.67741 6.08555 | 2.69355 7.29942 |
| 3 x B x | 2.68018 0.001131 9.010843 | 4.422225 7.166626 | 2.775519 7.537802 0.039047 | 2.731123 0.619958 4.711116 | 3.463554 0.772255 5.421246 | 2.405513 0.488376 5.602446 | 3.72494 0.948895 6.087702 | 3.29354 | 2.67741 | 2.69355 |
| 4 x B x | 2.68018 0.001100 1.107446 | 4.422225 7.307766 5.080055 | 2.775519 7.050013 8.161131 | 2.731123 0.619958 2.015899 | 3.463554 0.772255 5.904828 | 2.405513 0.490058 2.902030 | 3.72494 0.948895 3.001145 | 3.29354 5.29787 | 2.67741 6.08555 | 2.69355 3.71853 |
| 5 x G x | 2.68021 0.000100 4.287508 | 4.423390 4.047717 6.672140 | 2.775519 7.099887 8.560114 | 2.731123 0.619958 2.247639 | 3.463540 1.515804 0.191146 | 2.405513 0.490063 4.702044 | 3.72488 0.948895 3.001086 | 3.29357 4.857720 | 2.67740 2.867729 | 2.69358 2.69355 1.87835 |
| 6 x K x | 2.68018 0.000216 4.357320 | 4.422225 7.307800 5.080055 | 2.775539 7.530850 0.925581 | 2.731123 0.619958 3.105633 | 3.463554 0.111110 5.011831 | 2.405504 0.488963 0.385595 | 3.72490 0.948895 4.570090 | 3.29357 5.793575 | 2.678010 4.090330 | 2.69282 5.16050 |
| 7 x L x | 2.68018 0.000089 4.206619 | 4.421144 7.421182 | 2.775527 7.143379 4.527758 | 2.731123 0.619958 5.555867 | 3.463554 0.772255 4.884670 | 2.405513 0.488603 5.816677 | 3.72494 0.954607 5.699317 | 3.29354 2.225542 | 3.64007 4.06069 | 3.29017 0.63472 |
| | 2.68099 0.029928 | 4.422318 3.59310 | 2.77527 6.609934 | 2.731136 1.283977 | 3.46377 0.321426 | 2.405555 0.488923 | 3.72516 0.944959 | 3.29288 | 2.67738 | 2.69295 |

Fig. 14 cont.

|   | X | N | P | Q | R | S | T | V | W | Y |
|---|---|---|---|---|---|---|---|---|---|---|
|   | 4.62608 | 2.92144 | 3.17992 | 3.17307 | 2.68384 | 2.72433 | 2.26159 | 2.95172 | 4.68944 | 2.83156 |
|   | 4.24690 | 2.90347 | 2.73739 | 3.18146 | 2.89801 | 2.37887 | 2.77519 | 2.98518 | 4.58477 | 3.61503 |
| 1 | 7.56773 | 7.29231 | 7.97438 | 7.50711 | 7.66625 | 7.27201 | 7.72664 | 7.07046 | 2.58839 | 0.10045 |
|   | 4.24690 | 2.90347 | 2.73739 | 3.18146 | 2.89801 | 2.37887 | 2.77519 | 2.98518 | 4.58477 | 3.61503 |
| 2 | 8.30655 | 2.31091 | 6.73706 | 5.94960 | 6.94757 | 5.35070 | 4.55730 | 7.38052 | 7.09498 | 6.26671 |
|   | 4.24690 | 2.90347 | 2.73739 | 3.18146 | 2.89801 | 2.37887 | 2.77519 | 2.98518 | 4.58477 | 3.61503 |
| 3 | 5.65717 | 3.62903 | 2.83335 | 3.62812 | 3.09489 | 2.55022 | 3.47837 | 3.80902 | 6.82944 | 4.75087 |
|   | 4.24679 | 2.90347 | 2.73739 | 3.18146 | 2.89801 | 2.37887 | 2.77519 | 2.98518 | 4.58477 | 3.61503 |
| 4 | 5.01167 | 2.04433 | 5.07873 | 3.02941 | 2.60263 | 3.06683 | 3.73073 | 3.14830 | 4.73523 | 3.55479 |
|   | 4.24690 | 2.90346 | 2.73743 | 3.18149 | 2.89799 | 2.37887 | 2.77504 | 2.98521 | 4.58480 | 3.61499 |
| 6 | 5.38332 | 2.63131 | 5.63736 | 4.30296 | 3.87359 | 3.62417 | 4.56799 | 3.80915 | 6.87175 | 5.73424 |
|   | 4.23689 | 2.89950 | 2.73948 | 3.18385 | 2.89704 | 2.37969 | 2.77341 | 2.98736 | 4.58720 | 3.60823 |
| 23 | 5.51489 | 1.46254 | 5.64173 | 2.32026 | 0.83464 | 4.30791 | 4.58794 | 5.33492 | 4.88470 | 5.72939 |
|   | 4.24690 | 2.90347 | 2.73739 | 3.18146 | 2.89801 | 2.37887 | 2.77519 | 2.98518 | 4.58477 | 3.61503 |
| 24 | 4.07110 | 5.79259 | 3.13323 | 3.67019 | 3.98910 | 5.13760 | 3.99173 | 1.78439 | 6.52432 | 5.42244 |
|   | 4.24717 | 2.90388 | 2.73785 | 3.18071 | 2.89809 | 2.37882 | 2.77500 | 2.98513 | 4.58409 | 3.61552 |

Fig. 14 cont.

| ROW | A | C | D | E | F | G | H | I | K | L |
|---|---|---|---|---|---|---|---|---|---|---|
| 8 | 3.05640 | 5.47690 | 5.66524 | 4.45890 | 5.15039 | 5.01334 | 5.60108 | 1.92209 | 3.29011 | 2.14086 |
| x a | 2.67826 | 4.44302 | 2.77513 | 2.73972 | 3.46839 | 2.40407 | 3.73267 | 3.29515 | 2.69106 | 2.69050 |
| x b | 0.24341 | 1.53557 | 7.24164 | 3.61123 | 0.02739 | 0.48600 | 0.95472 | 5.72507 | 2.56516 | 4.47634 |
| 9 | 2.13403 | 5.56361 | 3.62534 | 2.08022 | 5.79764 | 2.91871 | 3.65632 | | | |
| x a | 2.68618 | 4.42225 | 2.77519 | 2.73123 | 3.46354 | 2.40513 | 3.72494 | 3.29354 | 2.67741 | 2.69355 |
| x b | 0.00536 | 7.46220 | 5.34547 | 0.61958 | 0.77255 | 0.49423 | 0.94171 | | | |
| 10 | 3.38109 | 5.67326 | 3.94875 | 2.51930 | 4.27439 | 5.39489 | 3.77110 | 1.91295 | 3.66246 | 2.84750 |
| x a | 2.68618 | 4.42225 | 2.77519 | 2.73123 | 3.46354 | 2.40513 | 3.72494 | 3.29354 | 2.67741 | 2.69355 |
| x b | 0.00460 | 7.46390 | 5.51821 | 0.61958 | 0.77255 | 0.62694 | 0.76405 | | | |
| 11 | 3.67341 | 5.67326 | 3.62670 | 3.25161 | 5.07443 | 3.97544 | 4.12298 | 2.65510 | 3.09709 | 3.73411 |
| x a | 2.68619 | 4.42240 | 2.77550 | 2.73141 | 3.46377 | 2.40490 | 3.72396 | 3.29309 | 2.67763 | 2.69371 |
| x b | 0.07026 | 6.28907 | 4.62906 | 0.45557 | 1.00536 | 0.54652 | 0.86504 | | | |
| 12 | 3.10896 | 2.83474 | 0.86312 | 3.33780 | 5.36638 | 3.12619 | 4.06628 | 5.06569 | 3.65014 | 2.94517 |
| x a | 2.68630 | 4.42263 | 2.77547 | 2.73134 | 3.46294 | 2.40496 | 3.72518 | 3.29348 | 2.67734 | 2.69322 |
| x b | 0.02891 | 3.61848 | 5.88519 | 1.07333 | 0.41835 | 0.49418 | 0.94179 | | | |
| 13 | 1.32927 | 5.06949 | 3.35616 | 2.86652 | 4.93914 | 2.65913 | 4.47344 | 5.45594 | 3.82308 | 3.76768 |

Fig. 14 cont.

| | X | N | P | Q | R | S | T | A | W | Y |
|---|---|---|---|---|---|---|---|---|---|---|
| 31 | 4.92193 / 4.25251 | 5.29737 / 2.89978 | 3.88325 / 2.75133 | 4.37100 / 3.18234 | 3.61598 / 2.89333 | 2.89120 / 2.38086 | 1.21452 / 2.76293 | 1.70103 / 2.98699 | 6.18481 / 4.54750 | 4.93983 / 3.58031 |
| 117 | 5.29057 / 4.24690 | 4.36336 / 2.90347 | 5.64461 / 2.73739 | 2.48195 / 3.18146 | 1.97404 / 2.89801 | 1.64905 / 2.37887 | 2.40697 / 2.77519 | 4.03745 / 2.98518 | 6.37479 / 4.58477 | 5.05110 / 3.61503 |
| 118 | 4.93773 / 4.24690 | 5.17581 / 2.90347 | 5.90264 / 2.73739 | 1.91092 / 3.18146 | 3.12288 / 2.89801 | 3.27931 / 2.37887 | 2.77509 / 2.77519 | 1.46717 / 2.98518 | 4.24383 / 4.58477 | 3.45602 / 3.61503 |
| 119 | 3.62690 / 4.24714 | 3.64351 / 2.90380 | 5.66106 / 2.73764 | 3.47317 / 3.18155 | 2.72316 / 2.89771 | 2.68716 / 2.37917 | 0.89651 / 2.77539 | 2.43235 / 2.98545 | 6.22642 / 4.58373 | 3.47206 / 3.61223 |
| 124 | 5.89489 / 4.24718 | 2.48109 / 2.90352 | 5.42402 / 2.73762 | 3.30261 / 3.18159 | 3.28194 / 2.89824 | 3.01038 / 2.37870 | 2.27359 / 2.77527 | 4.68625 / 2.98526 | 6.51151 / 4.58487 | 4.02569 / 3.61457 |
| 130 | 5.29308 | 3.55637 | 1.31768 | 3.41991 | 2.94601 | 2.79786 | 3.73748 | 3.90246 | 6.00564 | 5.20989 |

Fig. 14 cont.

| NUM | A | C | D | E | F | G | H | I | K | L |
|---|---|---|---|---|---|---|---|---|---|---|
| 14 X | 2.68251 0.08890 2.04540 | 4.42381 2.36898 4.59058 | 2.77222 7.28909 1.65765 | 2.73003 2.66015 2.89307 | 3.46060 3.07250 4.91841 | 2.40729 0.57698 2.99301 | 3.70931 3.82461 4.16333 | 3.29025 4.72607 | 2.69275 3.56788 | 2.69243 2.50473 |
| 15 X | 2.68618 0.00198 3.72949 | 4.42225 7.48285 6.75297 | 2.77519 6.55822 3.55773 | 2.73123 0.61958 3.12086 | 3.46354 0.77255 5.10035 | 2.40513 0.62872 0.37228 | 3.72494 0.76201 4.43081 | 3.29354 5.79960 | 3.67741 3.68056 | 2.69355 5.12420 |
| 16 X | 2.68618 0.00157 2.64305 | 4.42225 7.48348 6.59922 | 2.77519 6.89743 3.55844 | 2.73123 0.61958 2.95598 | 3.46354 0.77255 4.97454 | 2.40513 0.61904 3.19954 | 3.72494 0.73929 3.12954 | 3.29354 4.45610 | 2.67741 2.94651 | 2.69355 3.21311 |
| 17 X | 2.68618 0.13976 2.79218 | 4.42284 2.79810 3.71178 | 2.77547 3.66631 9.36547 | 2.73123 1.02519 2.84795 | 3.46364 0.44430 5.52943 | 2.40500 0.66591 4.65033 | 3.72420 0.72115 4.79446 | 3.29302 3.16478 | 2.67753 3.10397 | 2.69093 3.66060 |
| 18 X | 2.68618 0.00271 3.08990 | 4.42284 7.41451 6.37776 | 2.77519 6.16230 4.97996 | 2.73123 0.61958 3.16361 | 3.46354 0.77255 4.89594 | 2.40513 0.64904 3.37228 | 3.72494 0.73929 3.19954 | 3.29354 4.45610 | 2.67741 2.94651 | 2.69297 3.66060 |
| 19 X | 2.68329 0.26041 3.08990 | 4.42229 1.44760 1.44760 | 2.77520 9.20737 3.60358 | 2.73240 1.40070 2.35141 | 3.46290 0.44430 5.78710 | 2.40500 0.36752 3.50487 | 3.72420 0.72115 4.79446 | 3.29354 2.74987 | 2.94956 | 3.23976 |
| 20 X | 2.68779 0.19707 3.08990 | 4.44576 1.72261 1.79094 | 2.77528 8.21989 4.53668 | 2.73502 3.66511 5.76694 | 3.47521 0.02593 4.89760 | 2.40521 0.49776 5.86124 | 3.72670 0.72711 1.17912 3.89633 | 3.29354 5.54100 | 3.12063 | 2.69055 |
| 21 X | 2.68618 0.00811 1.94308 | 4.44229 4.85280 4.86632 | 2.77519 8.21989 4.53668 | 2.73127 0.22040 1.91858 | 3.46357 1.58867 5.21430 | 2.40514 0.49518 2.73989 | 3.72494 0.94023 3.34998 | 3.29357 4.05072 | 2.69569 5.54205 | 3.69783 3.44537 |
| 22 X | 2.68618 0.00082 2.66618 | 4.42225 7.49754 6.23234 | 2.77519 0.21988 4.11149 | 2.73145 0.69022 4.19229 | 3.46354 0.77255 4.20591 | 2.40513 0.49665 0.58107 | 3.72494 0.99794 3.63879 | 3.29354 4.78208 3.20494 | 2.67741 3.74228 | 2.69055 3.67783 2.68963 3.56780 |
| 23 X | 2.68574 0.03869 4.64751 | 4.42261 3.64621 7.10751 | 2.77533 4.43438 0.21685 | 2.73145 0.98909 4.10220 | 3.46380 0.46508 6.56271 | 2.40484 0.49665 4.23125 | 3.72494 0.93794 5.39512 | 4.87219 4.87219 | 2.67776 4.62676 | 4.37733 2.69385 5.64515 |

Fig. 14 cont.

| M | N | P | Q | R | S | T | V | W | Y | |
|---|---|---|---|---|---|---|---|---|---|---|
| 4.25039 | 2.90324 | 2.74224 | 3.18326 | 2.89419 | 2.38288 | 2.77497 | 2.98505 | 4.58587 | 3.60670 | |
| 4.01997 | 1.87658 | 5.29032 | 3.15792 | 2.88529 | 2.41311 | 3.04665 | 3.71952 | 6.63187 | 5.44025 | 158 |
| 4.24690 | 2.90347 | 2.73739 | 3.18146 | 2.89801 | 2.37887 | 2.77519 | 2.98518 | 4.58477 | 3.61503 | |
| 5.98072 | 3.24606 | 4.71099 | 3.44746 | 3.89573 | 3.72308 | 4.42885 | 4.48747 | 5.44035 | 5.02489 | 159 |
| 4.24690 | 2.90347 | 2.73739 | 3.18146 | 2.89801 | 2.37887 | 2.77519 | 2.98518 | 4.58477 | 3.61503 | |
| 5.52544 | 1.88980 | 4.53315 | 2.73974 | 1.69023 | 2.62957 | 2.49825 | 3.08874 | 5.08236 | 3.76735 | 160 |
| 4.24717 | 2.90366 | 2.73703 | 3.18104 | 2.89827 | 2.37901 | 2.77585 | 2.98558 | 4.58502 | 3.61505 | |
| 5.15297 | 4.41432 | 4.36590 | 3.22913 | 2.36457 | 2.63250 | 1.40099 | 1.69550 | 3.24641 | 5.21375 | 168 |
| 4.24690 | 2.90347 | 2.73739 | 3.18146 | 2.89801 | 2.37887 | 2.77519 | 2.98518 | 4.58477 | 3.61503 | |
| 5.22090 | 4.22157 | 5.04199 | 3.11864 | 2.90266 | 2.47256 | 0.94999 | 2.31212 | 3.11577 | 3.49672 | 169 |
| 4.24593 | 2.90396 | 2.73835 | 3.18080 | 2.89701 | 2.37956 | 2.77601 | 2.98392 | 4.58481 | 3.61385 | |
| 5.99860 | 3.61169 | 5.71046 | 2.53733 | 1.52175 | 2.52440 | 1.45641 | 4.32364 | 6.80069 | 4.29351 | 185 |
| 4.24544 | 2.90573 | 2.74874 | 3.17215 | 2.88442 | 2.38298 | 2.76507 | 2.97956 | 4.57755 | 3.59316 | |
| 3.98368 | 4.58898 | 6.32162 | 5.37229 | 5.11913 | 4.37481 | 3.53950 | 3.73374 | 3.24567 | 0.47493 | 265 |
| 4.24690 | 2.90344 | 2.73722 | 3.18146 | 2.89804 | 2.37888 | 2.77520 | 2.98518 | 4.58480 | 3.61507 | |
| 4.17864 | 4.17864 | 5.71285 | 2.62890 | 2.39786 | 2.56864 | 1.58534 | 3.53826 | 6.81226 | 5.09267 | 267 |
| 4.24690 | 2.90347 | 2.73739 | 3.18146 | 2.89801 | 2.37887 | 2.77519 | 2.98518 | 4.58477 | 3.61503 | |
| 6.00189 | 6.22255 | 4.12085 | 6.28071 | 4.01600 | 5.59440 | 5.37495 | 4.38176 | 4.08702 | 0.16745 | 268 |
| 4.24725 | 2.90376 | 2.73691 | 3.18162 | 2.89833 | 2.37866 | 2.77531 | 2.98518 | 4.58458 | 3.61506 | |
| 5.65060 | 4.17864 | 5.45506 | 4.85615 | 5.02914 | 3.74202 | 4.52573 | 5.74293 | 7.38663 | 6.09061 | 274 |
| 6.52095 | 2.62179 | | | | | | | | | |

Fig. 14 cont.

| EBM | | A | C | D | E | F | G | H | I | K | L |
|---|---|---|---|---|---|---|---|---|---|---|---|
| 24 | * 8 | 2.68618 0.00084 1.07881 | 4.42225 7.46340 6.18865 | 2.77519 8.20574 2.73639 | 2.73123 0.61958 2.27130 | 3.46354 0.77255 5.52088 | 2.40513 0.33775 2.62004 | 3.72494 1.24958 4.50050 | 3.29354 4.35752 | 2.67741 3.43861 | 2.69355 3.55326 |
| 25 | * 1 | 2.68616 0.01277 1.72403 | 4.42234 4.39202 5.17643 | 2.77525 8.05852 3.24174 | 2.73118 0.44589 3.43405 | 3.46362 1.02235 3.09107 | 2.40515 0.49320 3.64390 | 3.72472 0.94332 3.83367 | 3.29355 4.32829 | 2.67739 3.46762 | 2.69361 1.51806 |
| 26 | * 0 | 2.68618 0.00083 2.04046 | 4.42225 7.49192 5.47846 | 2.77519 8.21427 2.80412 | 2.73123 0.61958 4.09046 | 3.46354 0.77255 5.84617 | 2.40513 0.49509 0.44035 | 3.72494 0.94036 3.45873 | 3.29354 5.76906 | 2.67741 4.03900 | 2.69355 5.03513 |
| 27 | * R | 2.68527 0.04718 4.03502 | 4.41606 3.08720 6.61994 | 2.77494 7.70377 4.13781 | 2.73197 1.69486 3.84341 | 3.46477 0.20288 5.96011 | 2.40403 0.49665 5.08880 | 3.72565 0.93794 3.74303 | 3.29462 3.29464 | 2.67857 2.67741 | 2.69243 2.69243 |
| 28 | * 1 | 2.68465 0.09620 4.39968 | 4.41804 2.39202 4.67773 | 2.77503 8.19195 6.66814 | 2.73382 2.63350 5.05029 | 3.46491 0.07454 5.12645 | 2.40374 0.47532 5.85572 | 3.72765 0.97203 6.05655 | 5.81061 3.11565 | 3.63915 3.34608 | 3.62639 0.77650 |
| 29 | * 2 | 2.68618 0.00114 0.39968 | 4.41804 2.39202 4.67773 | 2.77519 7.48581 6.03560 | 2.73343 1.80552 2.21758 | 3.46701 0.17759 5.16502 | 2.40544 0.48004 2.71713 | 3.71714 0.96433 3.96891 | 3.29310 1.96751 | 2.68074 2.34986 | 2.69415 2.69355 |
| 30 | * 3 | 2.68760 0.19551 2.10604 | 4.42451 2.06824 4.03818 | 2.77541 8.03168 4.01209 | 2.73123 0.61958 2.03645 | 3.46354 0.77255 4.98943 | 2.40513 0.48496 5.49385 | 3.72494 0.95639 3.02690 | 3.29354 5.65417 | 2.67714 2.74102 | 2.69457 4.75802 |
| 31 | * 4 | 2.68618 0.00103 2.48591 | 4.42225 7.27381 7.27381 | 2.77519 7.99616 | 2.73123 0.61958 | 3.46354 0.77255 | 2.40513 0.48569 | 3.72494 0.95523 | 3.29354 1.78691 | 2.67741 2.74102 | 2.69355 2.75363 |

Fig. 14 cont.

| N | M | P | Q | R | S | T | U | V | W | X |
|---|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 | |
| 5.68787 | 3.35993 | 2.59369 | 3.95023 | 3.38003 | 2.60669 | 3.08893 | 3.32103 | 6.03033 | 5.40157 | 275 |
| 4.24685 | 2.90352 | 2.73743 | 3.18126 | 2.89798 | 2.37893 | 2.77513 | 2.98522 | 4.58486 | 3.61488 | |
| 3.73636 | 2.76468 | 5.29632 | 2.55005 | 2.72801 | 3.47032 | 3.35636 | 3.09836 | 3.79021 | 3.96609 | 278 |
| 4.24690 | 2.90347 | 2.73739 | 3.18146 | 2.89801 | 2.37887 | 2.77519 | 2.98518 | 4.58477 | 3.61503 | |
| 5.61944 | 2.62182 | 5.62263 | 4.30327 | 3.99690 | 3.54552 | 4.54710 | 5.29233 | 7.07452 | 3.14795 | 279 |
| 4.24778 | 2.90431 | 2.73774 | 3.18233 | 2.89777 | 2.37847 | 2.77586 | 2.98412 | 4.58605 | 3.61626 | |
| 5.68222 | 1.49700 | 5.38270 | 2.30214 | 0.75266 | 4.08943 | 3.95340 | 5.39682 | 5.62227 | 4.79669 | 290 |
| 4.24804 | 2.90106 | 2.73966 | 3.18091 | 2.89790 | 2.37892 | 2.77430 | 2.98462 | 4.58761 | 3.60790 | |
| 3.14721 | 5.53898 | 2.43331 | 3.51832 | 2.53671 | 5.05363 | 3.92716 | 1.93589 | 6.19025 | 5.53129 | 316 |
| 4.24690 | 2.90347 | 2.73739 | 3.18146 | 2.89801 | 2.37887 | 2.77519 | 2.98518 | 4.58477 | 3.61503 | |
| 4.94796 | 4.67836 | 6.12145 | 4.40163 | 4.38249 | 3.38558 | 2.17441 | 1.66833 | 6.57533 | 5.40572 | 317 |
| 4.23891 | 2.90304 | 2.73870 | 3.18173 | 2.89899 | 2.37951 | 2.77656 | 2.98304 | 4.57482 | 3.61050 | |
| 5.74536 | 4.30185 | 5.66006 | 2.48696 | 2.37392 | 1.63985 | 2.40687 | 3.67097 | 6.10679 | 5.60479 | 336 |
| 4.24690 | 2.90347 | 2.73739 | 3.18146 | 2.89801 | 2.37887 | 2.77519 | 2.98518 | 4.58477 | 3.61503 | |
| 3.59554 | 5.27839 | 5.98060 | 3.13859 | 3.05511 | 3.74879 | 2.40687 | 1.49274 | 6.03076 | 3.53114 | 337 |
| 4.24690 | 2.90347 | 2.73739 | 3.18146 | 2.89801 | 2.37887 | 2.77519 | 2.98518 | 4.58477 | 3.61503 | |

Fig. 14 cont.

| NUM | | A | C | D | E | F | G | H | I | K | L |
|---|---|---|---|---|---|---|---|---|---|---|---|
| 32 | x | 2.94345 | 6.53149 | 3.78345 | 2.76993 | 5.85591 | 4.90364 | 3.60675 | 2.50902 | 3.51657 | 3.72247 |
|  | y | 2.68611 | 4.42196 | 2.77497 | 2.73078 | 3.46263 | 2.40409 | 3.72407 | 3.29404 | 2.67869 | 2.69323 |
| 33 | x | 0.08237 | 2.54210 | 7.90380 | 1.70357 | 0.20093 | 0.48576 | 0.95510 | 5.55091 | 3.77402 | 3.09058 |
|  | y | 3.50576 | 6.47884 | 4.12007 | 3.18541 | 4.61089 | 3.28778 | 4.14338 | 3.29356 | 2.67743 | 2.69357 |
| 34 | x | 2.68620 | 4.42227 | 2.77521 | 2.73125 | 3.46356 | 2.40514 | 3.72496 | 5.38215 | 3.87665 | 4.86342 |
|  | y | 0.00699 | 5.02559 | 7.81883 | 0.32403 | 1.28457 | 0.48568 | 0.95523 | 3.29355 | 2.67744 | 2.69359 |
| 35 | x | 1.36697 | 6.05791 | 4.38971 | 3.30855 | 4.80418 | 3.68326 | 4.96277 | 3.34663 | 3.23965 | 2.51581 |
|  | y | 2.68608 | 4.42231 | 2.77523 | 2.73127 | 3.46329 | 2.40517 | 3.72501 | 3.29354 | 2.67741 | 2.69355 |
| 36 | x | 0.01627 | 4.15447 | 7.72313 | 0.41522 | 1.07937 | 0.48576 | 0.95510 | 5.34663 | 5.06181 | 6.62257 |
|  | y | 2.23234 | 6.16050 | 1.38222 | 3.11144 | 4.30788 | 3.48977 | 4.12555 | 7.19661 | 2.74819 | 4.30378 |
| 37 | x | 2.68618 | 4.42225 | 2.77519 | 2.73123 | 3.46354 | 2.40513 | 3.72494 | 3.29354 | 2.67741 | 2.69355 |
|  | y | 0.00146 | 3.92696 | 7.64931 | 0.61958 | 0.77255 | 0.48576 | 0.95510 | 4.09893 | 5.06181 | 6.31130 |
| 38 | x | 5.38420 | 8.01764 | 4.46464 | 4.51236 | 5.42349 | 3.08553 | 5.80009 | 4.89893 | 5.55091 | — |
|  | y | 2.68618 | 4.42225 | 2.77519 | 2.73123 | 3.46354 | 2.40513 | 3.72494 | 3.29354 | 2.74819 | 2.69355 |
|  | x | 0.00213 | 6.54706 | 7.26941 | 0.61958 | 0.77255 | 0.48576 | 0.95510 | 3.29354 | 2.67741 | 2.69355 |
|  | y | 2.47711 | 6.10408 | 3.92880 | 2.96456 | 5.42349 | 3.17889 | 3.76301 | 4.09893 | 2.74819 | 4.30378 |
|  | x | 2.68618 | 4.42225 | 2.77519 | 2.73123 | 3.46354 | 2.40513 | 3.72494 | 3.29354 | 2.67741 | 2.69355 |
|  | y | 0.00417 | 5.87878 | 6.60113 | 0.50074 | 0.99224 | 5.31109 | 7.17127 | 6.71278 | 6.55091 | 6.31130 |
|  | x | 4.86207 | 6.57942 | 6.45114 | 6.50074 | 6.99224 | 5.31109 | 7.17127 | 6.71278 | 6.55091 | 6.31130 |
|  | y | 2.68618 | 4.42225 | 2.77519 | 2.73123 | 3.46354 | 2.40513 | 3.72494 | 3.29354 | 2.67741 | 2.69355 |
|  | x | 0.00281 | 5.87742 | — | 0.61958 | 0.77255 | 0.00000 | 3.72494 | 3.29354 | 2.67741 | 2.69355 |

Fig. 14 cont.

| | M | N | P | Q | R | S | T | V | W | Y |
|---|---|---|---|---|---|---|---|---|---|---|
| 338 | 5.50355 / 4.24782 | 4.12449 / 2.90432 | 5.52537 / 2.73822 | 3.16635 / 3.18163 | 2.50841 / 2.89772 | 3.55453 / 2.37916 | 0.84439 / 2.77527 | 2.63520 / 2.98540 | 5.13553 / 4.58599 | 5.49475 / 3.61509 |
| 350 | 5.19998 / 4.24691 | 2.19845 / 2.90348 | 5.30351 / 2.73741 | 3.39541 / 3.18148 | 3.30429 / 2.89802 | 3.17726 / 2.37889 | 2.43779 / 2.77521 | 4.91320 / 2.98482 | 6.17536 / 4.58479 | 2.00135 / 3.61505 |
| 352 | 5.47577 / 4.24685 | 4.01268 / 2.90345 | 0.91709 / 2.73733 | 3.93684 / 3.18149 | 3.39147 / 2.89805 | 2.95915 / 2.37883 | 2.59373 / 2.77523 | 4.63123 / 2.98482 | 5.43813 / 4.58479 | 5.37672 / 3.61505 |
| 355 | 5.17593 / 4.24690 | 2.27134 / 2.90347 | 5.08374 / 2.73739 | 3.37261 / 3.18146 | 3.25163 / 2.89801 | 2.33469 / 2.37887 | 2.29043 / 2.77523 | 4.63678 / 2.98519 | 6.64062 / 4.58477 | 4.31315 / 3.61503 |
| 356 | 6.76323 / 4.24690 | 4.34408 / 2.90347 | 6.36740 / 2.73739 | 5.27361 / 3.18146 | 5.13442 / 2.89801 | 4.87643 / 2.37887 | 5.23458 / 2.77519 | 6.68908 / 2.98518 | 6.72296 / 4.58477 | 6.53552 / 3.61503 |
| 357 | 4.35793 / 4.24690 | 2.18375 / 2.90347 | 4.91089 / 2.73739 | 2.01550 / 3.18146 | 1.97622 / 2.89801 | 2.23602 / 2.37887 | 1.87651 / 2.77519 | 4.13677 / 2.98518 | 6.33596 / 4.58477 | 5.13788 / 3.61503 |
| 358 | 7.32434 / 4.24690 | 6.24626 / 2.90347 | 6.11498 / 2.73739 | 6.78963 / 3.18146 | 6.49991 / 2.89801 | 5.09060 / 2.37887 | 0.04124 / 2.77519 | 6.01581 / 2.98518 | 7.92354 / 4.58477 | 7.23324 / 3.61503 |

Fig. 14 cont.

```
HMMER3/b [3.0 | March 2010]
NAME  TIGR03696
ACC   TIGR03696
DESC  Rhs_assc_core: RHS repeat-associated core domain
LENG  76
ALPH  amino
RF    no
CS    no
MAP   yes
DATE  Sun Apr 11 22:27:34 2010
NSEQ  324
EFFN  3.485413
CKSUM 1516162093
GA    32.50 32.50;
TC    32.50 32.50;
NC    26.50 26.50;
STATS LOCAL MSV       -9.0695  0.71861
STATS LOCAL VITERBI   -9.8460  0.71861
STATS LOCAL FORWARD   -3.7627  0.71861
```

Fig. 15

| ROW COMPO | A m->m | C m->i | D m->d | E i->m | F i->i | G d->m | H d->d | I | K | L |
|---|---|---|---|---|---|---|---|---|---|---|
| | 2.64973 | 4.66087 | 2.72237 | 2.79793 | 3.16605 | 2.52515 | 3.72537 | 3.25219 | 2.87956 | 2.69168 |
| 1 | 2.68618 | 4.42225 | 2.77519 | 2.73123 | 3.46354 | 2.40513 | 3.72494 | 3.29354 | 2.67741 | 2.69355 |
| | 0.02030 | 5.04612 | 4.29290 | 0.61958 | 0.77255 | 0.00000 | | | | |
| | 3.35204 | 4.86554 | 4.82560 | 4.31018 | 2.62606 | 4.31409 | 4.04345 | 3.34911 | 4.16077 | 2.77677 |
| 2 | 2.68618 | 4.42225 | 2.77519 | 2.73123 | 3.46354 | 2.40513 | 3.72494 | 3.29354 | 2.67741 | 2.69355 |
| | 0.01120 | 5.03552 | 5.37349 | 0.61958 | 0.77255 | 0.47457 | 0.97326 | | | |
| | 2.62414 | 5.16353 | 3.21136 | 2.47505 | 4.08308 | 3.34706 | 3.66413 | 4.00847 | 2.34613 | 3.08848 |
| 3 | 2.68618 | 4.42225 | 2.77519 | 2.73123 | 3.46354 | 2.40513 | 3.72494 | 3.29354 | 2.67741 | 2.69355 |
| | 0.00963 | 5.04465 | 5.76536 | 0.61958 | 0.77255 | 0.48705 | 0.95305 | | | |
| | 1.73356 | 4.30153 | 3.54619 | 2.96210 | 4.04719 | 3.80061 | 4.14095 | 3.42128 | 3.06741 | 2.97890 |
| 4 | 2.68618 | 4.42225 | 2.77519 | 2.73123 | 3.46354 | 2.40513 | 3.72494 | 3.29354 | 2.67741 | 2.69355 |
| | 0.00362 | 5.04301 | 5.76700 | 0.61958 | 0.77255 | 0.48307 | 0.95510 | | | |
| | 3.98915 | 4.68717 | 4.94610 | 4.15896 | 1.24923 | 4.91490 | 3.89029 | 3.67794 | 4.82223 | 3.17915 |
| 5 | 2.68617 | 4.42221 | 2.77524 | 2.73116 | 3.46354 | 2.40517 | 3.72468 | 3.29358 | 2.67731 | 2.69345 |
| | 0.00960 | 3.09625 | 2.05315 | 0.80925 | 0.58914 | 0.48576 | 0.95510 | | | |
| | 2.90708 | 5.34279 | 3.86143 | 5.01042 | 5.49947 | 0.31939 | 5.33520 | 4.97562 | 4.22046 | 4.67398 |
| 6 | 2.68618 | 4.42225 | 2.77519 | 2.73123 | 3.46354 | 2.40513 | 3.72494 | 3.29354 | 2.67741 | 2.69355 |
| | 0.19061 | 5.34279 | 2.73535 | 1.96589 | 4.46979 | 2.48913 | 3.34439 | 3.68600 | 2.40744 | 3.61143 |
| | 2.45875 | | | | | | | | | |

Fig. 15 cont.

| | | 1 | 2 | 3 | 4 | 5 | 10 |
|---|---|---|---|---|---|---|---|
| Z | 2.65442<br>3.61503 | 0.64475<br>3.61503 | 2.69893<br>3.61503 | 4.17611<br>3.61503 | 1.15563<br>3.61503 | 5.65299<br>3.61507 | 3.85674<br>3.61503 |
| W | 4.35067<br>4.58477 | 4.32649<br>4.58477 | 5.70951<br>4.58477 | 5.43847<br>4.58477 | 1.94333<br>4.58477 | 6.80907<br>4.58467 | 5.77748<br>4.58477 |
| V | 2.97919<br>2.98518 | 3.16974<br>2.98518 | 3.71744<br>2.98518 | 2.69409<br>2.98518 | 3.52012<br>2.98518 | 4.23180<br>2.98523 | 3.56671<br>2.98518 |
| U | 2.87806<br>2.77519 | 3.11883<br>2.77519 | 2.39192<br>2.77519 | 2.84506<br>2.77519 | 4.03200<br>2.77519 | 3.59230<br>2.77524 | 2.98814<br>2.77519 |
| S | 2.75404<br>2.37887 | 3.53755<br>2.37887 | 2.18208<br>2.37887 | 2.72283<br>2.37887 | 3.82487<br>2.37887 | 3.22532<br>2.37889 | 2.65410<br>2.37887 |
| R | 2.81329<br>2.89801 | 4.29012<br>2.89801 | 2.93716<br>2.89801 | 3.46968<br>2.89801 | 4.63587<br>2.89801 | 4.68063<br>2.89803 | 2.77824<br>2.89801 |
| Q | 3.08079<br>3.18146 | 4.31240<br>3.18146 | 2.04801<br>3.18146 | 3.39030<br>3.18146 | 4.78180<br>3.18146 | 4.65903<br>3.18151 | 2.46970<br>3.18146 |
| P | 3.05177<br>2.73739 | 4.82282<br>2.73739 | 4.07147<br>2.73739 | 1.51668<br>2.73739 | 5.23329<br>2.73739 | 4.52426<br>2.73744 | 4.00848<br>2.73739 |
| N | 2.88325<br>2.90347 | 4.36277<br>2.90347 | 3.00340<br>2.90347 | 3.53130<br>2.90347 | 4.59079<br>2.90347 | 4.20652<br>2.90351 | 2.50825<br>2.90347 |
| M | 3.85686<br>4.24690 | 3.99600<br>4.24690 | 4.24059<br>4.24690 | 3.97472<br>4.24690 | 4.40405<br>4.24690 | 5.48239<br>4.24694 | 4.31444<br>4.24690 |

Fig. 15 cont.

| | A | C | D | E | F | G | H | I | K | L |
|---|---|---|---|---|---|---|---|---|---|---|
| 7 | 0.01099 | 4.91235 | 3.63470 | 0.61958 | 0.77255 | 0.79097 | 0.60404 | 2.56283 | 2.88139 | 2.37582 |
|  | 2.52814 | 4.31603 | 3.45017 | 2.89908 | 3.62451 | 3.69517 | 3.74213 | 3.29361 | 2.67741 | 2.69355 |
| 8 | 2.68598 | 4.42232 | 2.77526 | 2.73126 | 3.46352 | 2.40519 | 3.72489 | 3.29361 | 2.67741 | 2.69355 |
|  | 0.07643 | 2.93737 | 3.08359 | 1.07838 | 0.41574 | 0.34868 | 1.22289 | 2.04753 | 2.61346 | 2.31866 |
|  | 2.25613 | 4.72071 | 3.41057 | 2.70000 | 3.36438 | 3.57803 | 3.45324 |  |  |  |
| 9 | 2.68618 | 4.42225 | 2.77519 | 2.73123 | 3.46354 | 2.40513 | 3.72494 | 3.29354 | 2.67741 | 2.69355 |
|  | 0.00981 | 5.02532 | 5.74766 | 0.61958 | 0.77255 | 0.48496 | 0.95639 | 3.85601 | 2.38273 | 3.35447 |
|  | 2.39245 | 5.36879 | 2.90636 | 2.31932 | 4.53153 | 3.18226 | 3.28931 |  |  |  |
| 10 | 2.68616 | 4.42235 | 2.77519 | 2.73123 | 3.46366 | 2.40515 | 3.72499 | 3.29362 | 2.67742 | 2.69346 |
|  | 0.38874 | 1.29794 | 3.43853 | 0.22070 | 1.61926 | 0.48901 | 0.95631 | 3.85093 | 2.38273 | 3.35447 |
|  | 2.45734 | 5.28941 | 4.22949 | 2.22931 | 4.41775 | 3.00807 | 3.66444 | 3.38093 | 2.44647 | 2.89985 |
| 11 | 2.68618 | 4.42225 | 2.77519 | 2.73123 | 3.46354 | 2.40513 | 3.72494 | 3.29354 | 2.67741 | 2.69355 |
|  | 0.02143 | 5.01405 | 4.22949 | 0.61958 | 0.77255 | 0.54175 | 0.87162 | 3.86657 | 2.44919 | 3.08754 |
|  | 2.38905 | 5.17946 | 2.66170 | 2.22113 | 4.54707 | 2.86424 | 3.60612 |  |  |  |
| 12 | 2.68628 | 4.42235 | 2.77529 | 2.73107 | 3.46364 | 2.40523 | 3.72471 | 3.29364 | 2.67738 | 2.69365 |
|  | 0.28262 | 3.08518 | 1.61169 | 1.38704 | 0.28743 | 0.44357 | 1.02650 | 3.86657 | 2.44919 | 3.08754 |
|  | 2.21447 | 5.26509 | 2.67702 | 2.21203 | 4.36717 | 2.51351 | 3.78134 | 3.85399 | 2.48036 | 3.39128 |

Fig. 15 cont.

| | X | N | P | Q | R | S | T | V | W | Z | |
|---|---|---|---|---|---|---|---|---|---|---|---|
| | 3.53598 | 3.37034 | 3.47368 | 3.10206 | 2.84438 | 2.85827 | 2.09300 | 2.23091 | 5.21879 | 3.56340 | 11 |
| | 4.24674 | 2.90353 | 2.73746 | 3.18149 | 2.89807 | 2.37892 | 2.77517 | 2.98506 | 4.58452 | 3.61488 | |
| | 3.43765 | 3.37231 | 3.74764 | 2.87529 | 2.63104 | 2.76836 | 2.71540 | 2.55531 | 4.96368 | 3.49820 | 16 |
| | 4.24690 | 2.90347 | 2.73739 | 3.18146 | 2.89801 | 2.37887 | 2.77519 | 2.98518 | 4.58477 | 3.61503 | |
| | 4.34114 | 2.86220 | 3.16993 | 2.69883 | 2.47161 | 2.37798 | 2.74251 | 2.73823 | 4.81792 | 4.03552 | 17 |
| | 4.24693 | 2.90345 | 2.73748 | 3.18124 | 2.89810 | 2.37880 | 2.77506 | 2.98523 | 4.58491 | 3.61517 | |
| | 4.22199 | 2.63472 | 3.46562 | 2.68574 | 2.86830 | 2.52911 | 2.64147 | 2.95522 | 3.26759 | 4.36282 | 20 |
| | 4.24690 | 2.90347 | 2.73739 | 3.18146 | 2.89801 | 2.37887 | 2.77519 | 2.98518 | 4.58477 | 3.61503 | |
| | 4.41345 | 2.64577 | 3.49204 | 2.59449 | 2.80273 | 2.34826 | 2.65754 | 3.49454 | 5.52439 | 3.88312 | 21 |
| | 4.24700 | 2.90342 | 2.73724 | 3.18135 | 2.89811 | 2.37879 | 2.77529 | 2.98495 | 4.58487 | 3.61513 | |
| | 4.14810 | 2.61308 | 3.62315 | 2.69845 | 2.92158 | 2.36787 | 2.55600 | 3.07222 | 5.29104 | 4.23556 | 28 |

Fig. 15 cont.

| Num | A | C | D | E | F | G | H | I | K | L |
|---|---|---|---|---|---|---|---|---|---|---|
| 13 | 2.68548 | 4.42295 | 2.77515 | 2.73099 | 3.46404 | 2.40513 | 3.72517 | 3.29376 | 2.67760 | 2.69393 |
|  | 0.76324 | 0.63837 | 5.16848 | 1.44445 | 0.26902 | 0.29139 | 1.37525 |  | 2.78636 | 2.31625 |
| 14 | 2.31570 | 4.67290 | 2.95361 | 2.88016 | 3.30842 | 3.05675 | 4.01264 | 2.76561 | 2.78636 | 2.31625 |
|  | 2.68618 | 4.42225 | 2.77519 | 2.73123 | 3.46354 | 2.40513 | 3.72494 | 3.29354 | 2.67741 | 2.69355 |
| 15 | 0.02106 | 5.04053 | 4.24244 | 0.61958 | 0.77255 | 0.48899 | 0.94997 | 3.54274 | 2.41806 | 3.09727 |
|  | 2.49313 | 5.36117 | 2.62765 | 2.99482 | 4.37128 | 3.11929 | 3.12550 | 3.29354 | 2.67741 | 2.69355 |
| 16 | 2.68618 | 4.42225 | 2.77519 | 2.73123 | 3.46354 | 2.40513 | 3.72494 | 3.29354 | 2.67741 | 2.69355 |
|  | 0.02914 | 5.03203 | 3.80806 | 0.61958 | 0.77255 | 0.46125 | 0.99659 |  |  |  |
| 17 | 2.67903 | 4.44513 | 2.96570 | 2.56639 | 4.07871 | 3.18192 | 3.70555 | 3.67589 | 2.18752 | 3.34494 |
|  | 2.68618 | 4.42225 | 2.77519 | 2.73123 | 3.46354 | 2.40513 | 3.72494 | 3.29354 | 2.67741 | 2.69355 |
| 18 | 0.00979 | 5.02718 | 5.74953 | 0.61958 | 0.77255 | 0.45347 | 1.00901 | 3.81773 | 2.41840 | 2.98859 |
|  | 2.51955 | 5.13078 | 2.83066 | 2.49717 | 3.82081 | 3.22322 | 3.47022 | 3.29354 | 2.67741 | 2.69355 |
|  | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 |  |  |  |
|  | 2.90594 | 4.32161 | 4.78515 | 3.39537 | 2.49375 | 4.08680 | 4.16088 | 2.09028 | 3.70858 | 1.58492 |
|  | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 |  |  |  |
|  | 2.62016 | 5.01347 | 3.23034 | 2.61029 | 4.59839 | 2.11406 | 3.89668 | 4.04709 | 2.32024 | 3.22471 |
|  | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 |  |  |  |

| NUM | A | C | D | E | F | G | H | I | K | L |
|---|---|---|---|---|---|---|---|---|---|---|
| 19 | 4.86869 | 5.86069 | 5.85066 | 5.73647 | 0.81127 | 5.45192 | 3.41669 | 4.50443 | 5.51177 | 2.91150 |
|  | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.79135 | 2.62730 | 3.28530 |
|  | 2.21488 | 4.77277 | 3.21646 | 2.65985 | 4.53546 | 3.64702 | 3.89413 | 3.29354 | 2.67741 | 2.69355 |
| 20 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.79135 | 2.62730 | 3.28530 |
| 21 | 3.09728 | 5.32853 | 3.06981 | 3.05815 | 5.21666 | 0.53640 | 4.62105 | 4.67843 | 3.59769 | 4.27189 |
|  | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 4.22444 | 1.93269 | 3.70382 |
| 22 | 2.76176 | 5.40086 | 3.12463 | 2.03647 | 4.74261 | 3.25206 | 3.08967 | 4.22444 | 1.93269 | 3.70382 |
|  | 2.68620 | 4.42227 | 2.77521 | 2.73121 | 3.46348 | 2.40506 | 3.72496 | 3.50958 | 2.69228 | 2.93919 |
| 23 | 0.03807 | 3.48911 | 4.98681 | 0.59705 | 0.79947 | 0.47902 | 0.96598 | 3.50958 | 2.69228 | 2.93919 |
|  | 2.61800 | 5.07018 | 3.32016 | 1.81350 | 3.95467 | 3.73864 | 3.65105 |  |  |  |
| 24 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76475 | 0.61958 | 0.77255 | 0.48576 | 0.95510 | 3.08764 | 2.88926 | 2.21558 |
|  | 2.64922 | 4.67772 | 3.53071 | 2.71424 | 2.82438 | 3.80746 | 3.11298 | 3.29354 | 2.67741 | 2.69355 |
| 25 | 2.90325 | 5.33915 | 1.07777 | 2.33095 | 4.62448 | 3.70055 | 3.84532 | 3.88059 | 2.68313 | 3.28008 |

Fig. 15 cont.

| M | N | P | Q | R | S | T | V | W | Y | |
|---|---|---|---|---|---|---|---|---|---|---|
| 4.51782 | 5.03060 | 5.71239 | 5.19141 | 5.32250 | 4.84362 | 5.06534 | 4.42292 | 3.82970 | 1.04026 | 51 |
| 4.24690 | 2.90347 | 2.73739 | 3.18146 | 2.89801 | 2.37887 | 2.77519 | 2.98518 | 4.58477 | 3.61503 | 52 |
| 4.30782 | 2.26215 | 3.10434 | 2.26281 | 3.08826 | 2.30420 | 2.12045 | 3.30002 | 5.72131 | 4.35014 | |
| 4.24690 | 2.90347 | 2.73739 | 3.18146 | 2.89801 | 2.37887 | 2.77519 | 2.98518 | 4.58477 | 3.61503 | 53 |
| 5.10294 | 3.50694 | 4.44326 | 3.82418 | 3.74179 | 3.04193 | 3.17892 | 4.16940 | 6.47677 | 5.13461 | |
| 4.24690 | 2.90347 | 2.73739 | 3.18146 | 2.89801 | 2.37887 | 2.77519 | 2.98518 | 4.58477 | 3.61503 | 54 |
| 4.32887 | 3.14518 | 4.06947 | 1.62096 | 2.96392 | 2.81802 | 3.13319 | 3.73809 | 5.83435 | 3.56543 | |
| 4.24691 | 2.90348 | 2.73741 | 3.18148 | 2.89802 | 2.37888 | 2.77521 | 2.98516 | 4.58462 | 3.61490 | 57 |
| 3.94971 | 3.19040 | 3.60391 | 2.62808 | 2.67769 | 2.93100 | 3.00556 | 2.81000 | 3.80768 | 2.32252 | |
| 4.24690 | 2.90347 | 2.73739 | 3.18146 | 2.89801 | 2.37887 | 2.77519 | 2.98518 | 4.58477 | 3.61503 | 58 |
| 3.17451 | 3.32590 | 4.04392 | 2.88655 | 2.36915 | 3.00520 | 2.90783 | 2.31000 | 4.16797 | 2.66752 | |
| 4.24690 | 2.90347 | 2.73739 | 3.18146 | 2.89801 | 2.37887 | 2.77519 | 2.98518 | 4.58477 | 3.61503 | 59 |
| 4.37556 | 3.02673 | 4.11329 | 2.82024 | 3.17534 | 2.81828 | 3.17131 | 3.66582 | 5.84355 | 4.45112 | |

Fig. 15 cont.

| HRM | # | A | C | D | E | F | G | H | I | K | L |
|---|---|---|---|---|---|---|---|---|---|---|---|
| | 26 | 2.68618 | 4.42225 | 2.77519 | 2.73123 | 3.46354 | 2.40513 | 3.72494 | 3.29354 | 2.67741 | 2.69355 |
| | | 0.02860 | 5.04612 | 3.82423 | 0.61958 | 0.77255 | 0.48576 | 0.95510 | 3.99853 | 2.36851 | 2.69355 |
| | | 2.19351 | 5.38393 | 2.53277 | 2.03176 | 4.72326 | 3.22157 | 3.59903 | | | 3.45111 |
| | 27 | 2.68618 | 4.42225 | 2.77519 | 2.73123 | 3.46354 | 2.40513 | 3.72494 | 3.29354 | 2.67741 | 2.69355 |
| | | 0.12651 | 5.02723 | 2.18681 | 0.61958 | 0.77255 | 0.45354 | 1.00888 | 3.82906 | 2.49651 | 3.26492 |
| | | 2.44728 | 5.11608 | 2.63125 | 1.45196 | 4.16239 | 3.21681 | 3.68527 | | | |
| | 28 | 2.68617 | 4.42226 | 2.77520 | 2.73124 | 3.46355 | 2.40512 | 3.72495 | 3.29355 | 2.67742 | 2.69350 |
| | | 0.05508 | 3.34728 | 3.99503 | 0.40948 | 1.09064 | 0.34582 | 1.22977 | 3.15521 | 2.97143 | 2.49961 |
| | | 2.72920 | 4.79804 | 3.42023 | 2.99646 | 3.65839 | 3.75862 | 4.05408 | | | |
| | 29 | 2.68618 | 4.42226 | 2.77519 | 2.73123 | 3.46354 | 2.40513 | 3.72494 | 3.29354 | 2.67741 | 2.69355 |
| | | 0.00974 | 5.03271 | 5.75506 | 0.61958 | 0.77255 | 0.49579 | 0.93927 | 4.22674 | 2.65434 | 3.74819 |
| | | 2.98011 | 5.21522 | 2.63058 | 2.63058 | 4.76347 | 1.02639 | 3.79690 | | | |
| | 30 | 2.68619 | 4.42226 | 2.77521 | 2.73124 | 3.46355 | 2.40514 | 3.72494 | 3.29355 | 2.67742 | 2.69356 |
| | | 0.03836 | 3.36727 | 5.76115 | 0.39450 | 1.12091 | 0.47268 | 0.97638 | 2.71997 | 3.76608 | 0.97991 |
| | | 2.85079 | 3.97978 | 4.66117 | 4.06042 | 3.18499 | 4.07058 | 3.96041 | | | |
| | 31 | 2.68629 | 4.42238 | 2.77525 | 2.73136 | 3.46356 | 2.40526 | 3.72457 | 3.29367 | 2.67754 | 2.69331 |
| | | 0.17634 | 1.84173 | 5.76846 | 0.67951 | 0.70697 | 0.48576 | 0.95510 | 2.67273 | 3.50035 | 1.94163 |
| | | 2.90932 | 4.12935 | 3.78373 | 3.50391 | 3.48880 | 3.86791 | 2.40108 | | | |

Fig. 15 cont.

| M | N | P | Q | R | S | T | V | W | Y |
|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 |
| 4.42610 | 3.08832 | 2.88553 | 2.78323 | 2.66037 | 2.55115 | 2.82101 | 2.96506 | 5.55121 | 4.16782 (60) |
| 4.24690 | 2.90347 | 2.73739 | 3.18146 | 2.89801 | 2.37887 | 2.77519 | 2.98518 | 4.58477 | 3.61503 |
| 4.26195 | 2.92174 | 3.78415 | 2.87672 | 3.05537 | 2.57188 | 2.95423 | 3.25253 | 5.40157 | 4.35134 (61) |
| 4.24691 | 2.90348 | 2.73740 | 3.18147 | 2.89802 | 2.37885 | 2.77520 | 2.98516 | 4.58478 | 3.61504 |
| 3.84059 | 3.09285 | 4.20424 | 3.22443 | 3.38098 | 2.02605 | 1.41037 | 2.93103 | 5.35968 | 4.05173 (63) |
| 4.24690 | 2.90347 | 2.73739 | 3.18146 | 2.89801 | 2.37887 | 2.77519 | 2.98518 | 4.58477 | 3.61503 |
| 4.52396 | 2.94238 | 4.16892 | 3.06464 | 3.13470 | 2.87269 | 3.27190 | 3.69825 | 5.91747 | 4.52083 (64) |
| 4.24691 | 2.90348 | 2.73740 | 3.18147 | 2.89802 | 2.37888 | 2.77521 | 2.98518 | 4.58478 | 3.61469 |
| 3.20125 | 4.01478 | 4.43670 | 3.41490 | 3.73100 | 3.20507 | 3.11009 | 2.48731 | 3.51776 | 3.52154 (66) |
| 4.24625 | 2.90340 | 2.73749 | 3.18151 | 2.89814 | 2.37899 | 2.77531 | 2.98531 | 4.58470 | 3.61342 |
| 3.47450 | 3.53394 | 4.35831 | 3.63274 | 3.75039 | 3.06107 | 2.86834 | 2.42400 | 5.07122 | 1.76947 (69) |

Fig. 15 cont.

| RM | A | C | D | E | F | G | H | I | K | L |
|---|---|---|---|---|---|---|---|---|---|---|
| 32 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 2.61104 | 3.18815 |
|  | 2.79661 | 5.17884 | 2.76869 | 2.60799 | 3.75157 | 2.45067 | 3.14319 | 3.00862 | 2.61104 | 3.18815 |
| 33 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 2.61104 | 3.18815 |
|  | 2.79160 | 4.19402 | 4.00084 | 3.47110 | 3.02395 | 3.81297 | 4.06229 | 2.92343 | 3.36858 | 2.20882 |
| 34 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 2.52175 | 2.20882 |
|  | 2.89737 | 5.28989 | 3.14160 | 2.61714 | 4.41686 | 1.72105 | 3.51321 | 3.00792 | 2.52175 | 3.20627 |
| 35 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 3.06908 | 2.63178 |
|  | 1.75612 | 4.64941 | 3.77072 | 3.20375 | 2.79338 | 3.43801 | 2.92981 | 3.15084 | 3.06908 | 2.63178 |
| 36 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 3.22836 | 4.64530 |
|  | 4.18174 | 4.85305 | 5.26446 | 4.53817 | 5.64543 | 4.59928 | 5.00493 | 5.21419 | 3.22836 | 4.64530 |
| 37 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 3.39311 | 2.41809 |
|  | 2.36289 | 4.44698 | 3.48754 | 3.31299 | 2.91505 | 3.79954 | 0.46432 | 2.91195 | 3.39311 | 2.41809 |

Fig. 15 cont.

| X | M | N | O | P | Q | R | S | T | U | V | W | Y | |
|---|---|---|---|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 | | | | |
| 4.24322 | 2.88874 | 4.10827 | 2.97103 | 3.07444 | 2.86582 | 3.13447 | 3.52290 | 5.66536 | 1.62562 | | | | 70 |
| 4.24690 | 2.90347 | 2.73739 | 3.18146 | 2.89801 | 2.37887 | 2.77519 | 2.98518 | 4.58477 | 3.61503 | | | | 71 |
| 2.66390 | 1.86467 | 4.33358 | 3.44669 | 3.34179 | 3.03752 | 3.04949 | 2.73929 | 5.11092 | 2.14050 | | | | 72 |
| 4.24690 | 2.90347 | 2.73739 | 3.18146 | 2.89801 | 2.37887 | 2.77519 | 2.98518 | 4.58477 | 3.61503 | | | | 73 |
| 3.95012 | 2.77718 | 3.90174 | 2.72950 | 2.05732 | 2.83749 | 2.85101 | 3.53771 | 5.25988 | 3.94975 | | | | 74 |
| 4.24690 | 2.90347 | 2.73739 | 3.18146 | 2.89801 | 2.37887 | 2.77519 | 2.98518 | 4.58477 | 3.61503 | | | | 75 |
| 3.72167 | 3.35619 | 4.26839 | 3.18644 | 3.25511 | 2.88983 | 3.06436 | 2.74689 | 4.72939 | 2.13787 | | | | |
| 4.24690 | 2.90347 | 2.73739 | 3.18146 | 2.89801 | 2.37887 | 2.77519 | 2.98518 | 4.58477 | 3.61503 | | | | |
| 5.64537 | 4.71152 | 5.14701 | 4.22134 | 0.20470 | 4.30225 | 4.49299 | 4.85952 | 6.48244 | 5.47989 | | | | |
| 4.24690 | 2.90347 | 2.73739 | 3.18146 | 2.89801 | 2.37887 | 2.77519 | 2.98518 | 4.58477 | 3.61503 | | | | |
| 3.42470 | 3.48445 | 4.07935 | 3.55161 | 3.54083 | 3.08108 | 3.01830 | 2.59222 | 4.09037 | 1.60921 | | | | |

Fig. 15 cont.

| FORM | A | C | D | E | F | G | H | I | K | L |
|---|---|---|---|---|---|---|---|---|---|---|
| 38 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 5.08235 | 5.99077 | 5.91325 | 5.85933 | 2.08930 | 5.55548 | 4.17173 | 4.62428 | 5.62308 | 3.65035 |
| 39 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.48230 | 4.68126 | 1.55233 | 2.48841 | 4.57832 | 3.67474 | 3.63091 | 3.96666 | 2.58424 | 3.42950 |
| 40 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.59687 | 4.74452 | 3.46130 | 3.02121 | 4.33174 | 3.43231 | 4.17184 | 3.79952 | 3.02146 | 3.39180 |
| 41 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.34248 | 5.05132 | 2.62758 | 2.18175 | 4.67014 | 2.79070 | 3.76701 | 3.95023 | 2.47822 | 3.36664 |
| 42 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.64402 | 4.12504 | 4.60398 | 3.95238 | 3.45120 | 3.89953 | 4.08659 | 2.06172 | 3.85005 | 1.40829 |
| 43 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.44153 | 4.64323 | 3.52146 | 2.96447 | 4.12481 | 1.24479 | 3.97522 | 3.51052 | 2.89231 | 3.17158 |
| | 2.68618 | 4.42225 | 2.77519 | 2.73123 | 3.46354 | 2.40513 | 3.72494 | 3.29354 | 2.67741 | 2.69355 |
| | 0.00960 | 5.04612 | 5.76846 | 0.61958 | 0.77255 | 0.48576 | 0.95510 | | | |

Fig. 15 cont.

| x | x | p | q | r | s | t | v | w | y | |
|---|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 | |
| 4.79385 | 5.07896 | 5.80022 | 5.25386 | 5.40689 | 4.96128 | 5.27042 | 4.30958 | 3.97714 | 0.31239 | 76 |
| 4.24690 | 2.90347 | 2.73739 | 3.18146 | 2.89801 | 2.37887 | 2.77519 | 2.98518 | 4.58477 | 3.61503 | |
| 4.15237 | 2.40706 | 3.98166 | 2.64336 | 3.04577 | 2.37388 | 3.06549 | 3.73178 | 5.81268 | 4.29470 | 77 |
| 4.24690 | 2.90347 | 2.73739 | 3.18146 | 2.89801 | 2.37887 | 2.77519 | 2.98518 | 4.58477 | 3.61503 | |
| 4.26989 | 3.47714 | 0.95845 | 3.03734 | 3.45213 | 2.75293 | 2.98753 | 3.46142 | 5.70918 | 4.25718 | 78 |
| 4.24690 | 2.90347 | 2.73739 | 3.18146 | 2.89801 | 2.37887 | 2.77519 | 2.98518 | 4.58477 | 3.61503 | |
| 4.05513 | 2.74955 | 3.94435 | 2.76086 | 2.90210 | 2.49098 | 2.74102 | 3.10706 | 2.92294 | 4.11930 | 79 |
| 4.24690 | 2.90347 | 2.73739 | 3.18146 | 2.89801 | 2.37887 | 2.77519 | 2.98518 | 4.58477 | 3.61503 | |
| 3.15701 | 3.83224 | 4.42911 | 3.36607 | 3.81401 | 2.91165 | 2.39753 | 2.22177 | 4.65513 | 3.66809 | 80 |
| 4.24690 | 2.90347 | 2.73739 | 3.18146 | 2.89801 | 2.37887 | 2.77519 | 2.98518 | 4.58477 | 3.61503 | |
| 2.68355 | 3.43743 | 4.09155 | 3.01974 | 2.89241 | 2.99630 | 3.17078 | 3.23490 | 5.47593 | 4.19551 | 81 |
| 4.24690 | 2.90347 | 2.73739 | 3.18146 | 2.89801 | 2.37887 | 2.77519 | 2.98518 | 4.58477 | 3.61503 | |

Fig. 15 cont.

| INDEX | A | C | D | E | F | G | H | I | K | L |
|---|---|---|---|---|---|---|---|---|---|---|
| 44 | 3.01467 | 4.59095 | 3.52572 | 2.93152 | 4.45454 | 3.77178 | 3.82933 | 3.77878 | 2.50130 | 3.40334 |
| | 2.68618 | 4.42225 | 2.77519 | 2.73123 | 3.46354 | 2.40513 | 3.72494 | 3.29354 | 2.67741 | 2.69355 |
| | 0.00960 | 5.04612 | 5.76846 | 0.61958 | 0.77255 | 0.48576 | 0.95510 | | | |
| 45 | 5.19933 | 6.04504 | 5.96655 | 5.98803 | 0.62543 | 5.60471 | 4.16107 | 4.74112 | 5.72824 | 3.55032 |
| | 2.68618 | 4.42225 | 2.77519 | 2.73123 | 3.46354 | 2.40513 | 3.72494 | 3.29354 | 2.67741 | 2.69355 |
| | 0.00960 | 5.04612 | 5.76846 | 0.61958 | 0.77255 | 0.48576 | 0.95510 | | | |
| 46 | 2.83256 | 3.93911 | 4.74052 | 4.13518 | 3.34354 | 3.84149 | 3.34256 | 1.84950 | 3.95261 | 1.64032 |
| | 2.68618 | 4.42225 | 2.77519 | 2.73123 | 3.46354 | 2.40513 | 3.72494 | 3.29354 | 2.67741 | 2.69355 |
| | 0.00960 | 5.04612 | 5.76846 | 0.61958 | 0.77255 | 0.48576 | 0.95510 | | | |
| 47 | 2.52290 | 5.01007 | 3.18484 | 2.61206 | 4.63566 | 3.42080 | 3.76036 | 4.09758 | 2.60140 | 3.61574 |
| | 2.68618 | 4.42225 | 2.77519 | 2.73123 | 3.46354 | 2.40513 | 3.72494 | 3.29354 | 2.67741 | 2.69355 |
| | 0.00960 | 5.04612 | 5.76846 | 0.61958 | 0.77255 | 0.48576 | 0.95510 | | | |
| 48 | 2.68618 | 4.42225 | 2.77519 | 2.53311 | 3.46354 | 2.40513 | 3.85872 | 3.34740 | 2.39795 | 3.24555 |
| | 0.01153 | 5.04612 | 5.29229 | 2.73123 | 0.77255 | 0.48576 | 3.72494 | 3.29354 | 2.67741 | 2.69355 |
| | | | | 0.61958 | | | | | | |
| 49 | 2.23358 | 4.86297 | 3.21541 | 2.94485 | 4.48012 | 3.59707 | 4.94669 | 5.82690 | 4.23577 | 5.26428 |
| | 2.68618 | 4.42225 | 2.77520 | 2.73137 | 3.46344 | 2.40530 | 3.72507 | 3.29357 | 2.67763 | 2.69336 |
| | 0.00962 | 5.04421 | 5.76655 | 0.61958 | 0.77255 | 0.49138 | 0.94619 | | | |
| 50 | 4.20409 | 6.63880 | 0.23270 | 1.10127 | 6.08395 | 4.14583 | 4.94669 | 3.29357 | 2.67763 | 2.69336 |
| | 2.68630 | 1.72243 | 4.10336 | 2.53311 | 0.40414 | 0.49138 | 0.94619 | | | |
| | 0.21710 | | | | | | | | | |
| | 2.89943 | 4.92339 | 3.53339 | 3.13579 | 4.31670 | 3.77004 | 4.22625 | 3.54971 | 3.02992 | 3.26882 |

Fig. 15 cont.

| N | M | P | Q | R | S | T | U | V | W | Z | |
|---|---|---|---|---|---|---|---|---|---|---|---|
| 4.27378 | 3.37577 | 4.05276 | 2.94328 | 0.92436 | 3.02125 | 3.08559 | 3.04440 | 5.66594 | 4.37848 | 82 |
| 4.24690 | 2.90347 | 2.73739 | 3.18146 | 2.89801 | 2.37887 | 2.77519 | 2.98519 | 4.58477 | 3.61503 | 83 |
| 5.24177 | 5.10115 | 5.84319 | 5.29650 | 5.46832 | 5.01804 | 5.38046 | 4.70250 | 1.69326 | 1.80487 | 84 |
| 4.24690 | 2.90347 | 2.73739 | 3.18146 | 2.89801 | 2.37887 | 2.77519 | 2.98519 | 4.58477 | 3.61503 | |
| 2.98277 | 3.29470 | 3.44639 | 4.04081 | 4.01453 | 3.24196 | 2.36126 | 2.09717 | 4.79763 | 3.35455 | 85 |
| 4.24690 | 2.90347 | 2.73739 | 3.18146 | 2.89801 | 2.37887 | 2.77519 | 2.98519 | 4.58477 | 3.61503 | |
| 4.37584 | 2.61773 | 4.08086 | 2.29140 | 3.03345 | 1.41573 | 2.56543 | 2.09717 | 5.77943 | 4.39132 | 86 |
| 4.24690 | 2.90347 | 2.73739 | 3.18146 | 2.89801 | 2.37887 | 2.77519 | 2.98519 | 4.58477 | 3.61503 | |
| 3.60800 | 3.05533 | 1.94571 | 2.49415 | 2.80655 | 2.75123 | 2.94700 | 3.07156 | 5.68859 | 4.22767 | 87 |
| 4.24690 | 2.90347 | 2.73739 | 3.18146 | 2.89801 | 2.37887 | 2.77519 | 2.98519 | 4.58477 | 3.61503 | |
| 6.28358 | 3.69775 | 4.87271 | 4.17914 | 4.94795 | 4.03895 | 4.56579 | 5.34200 | 7.14607 | 5.73848 | |
| 4.24674 | 2.90353 | 2.73736 | 3.18166 | 2.89818 | 2.37820 | 2.77530 | 2.98519 | 4.58398 | 3.61523 | |
| 4.21754 | 3.56383 | 0.86353 | 3.44441 | 3.19741 | 2.88243 | 3.01280 | 3.20560 | 5.65698 | 4.39028 | 93 |

Fig. 15 cont.

| NUM | A | C | D | E | F | G | H | I | K | L |
|---|---|---|---|---|---|---|---|---|---|---|
| 51 | 2.68617 | 4.42227 | 2.77522 | 2.73125 | 3.46356 | 2.40515 | 3.72497 | 3.29356 | 2.67743 | 2.69357 |
| | 0.11525 | 3.57797 | 2.51425 | 0.75186 | 0.63769 | 0.49522 | 0.94017 | 1.63621 | 3.78935 | 2.00094 |
| | 2.22575 | 4.27562 | 4.42208 | 4.14669 | 2.16037 | 3.87320 | 4.37343 | | | |
| 52 | 2.68617 | 4.42227 | 2.77518 | 2.73125 | 3.46355 | 2.40514 | 3.72496 | 3.29355 | 2.67742 | 2.69356 |
| | 0.09069 | 3.20455 | 3.07648 | 0.45592 | 1.00475 | 0.45592 | 1.00476 | | | |
| | 2.52655 | 5.29163 | 2.98562 | 2.37269 | 4.27428 | 1.48535 | 3.84845 | 3.96183 | 2.47606 | 3.50219 |
| 53 | 2.68618 | 4.42225 | 2.77519 | 2.73123 | 3.46354 | 2.40513 | 3.72494 | 3.29354 | 2.67741 | 2.69355 |
| | 0.01026 | 4.98027 | 5.70262 | 0.61958 | 0.77255 | 0.42357 | 1.06336 | | | |
| | 2.65824 | 4.34340 | 2.98519 | 2.33897 | 3.25004 | 3.38420 | 3.79123 | 3.06707 | 2.66584 | 1.98642 |
| 54 | 2.68618 | 4.42225 | 2.77519 | 2.73123 | 3.46354 | 2.40513 | 3.72494 | 3.29354 | 2.67741 | 2.69355 |
| | 0.00969 | 5.03745 | 5.75979 | 0.61958 | 0.77255 | 0.47034 | 0.98027 | | | |
| | 2.18089 | 5.35590 | 2.74199 | 2.32128 | 4.48439 | 2.41055 | 3.66630 | 3.67895 | 2.44253 | 3.20300 |
| 55 | 2.68618 | 4.42225 | 2.77519 | 2.73123 | 3.46354 | 2.40513 | 3.72494 | 3.29354 | 2.67741 | 2.69355 |
| | 0.01196 | 5.04612 | 5.21041 | 0.61958 | 0.77255 | 0.48576 | 0.95510 | | | |
| | 2.63839 | 5.34701 | 2.18090 | 2.46470 | 4.59546 | 1.53553 | 3.87651 | 4.05224 | 2.44253 | 3.64112 |
| 56 | 2.68618 | 4.42225 | 2.77519 | 2.73123 | 3.46354 | 2.40513 | 3.72494 | 3.29354 | 2.67741 | 2.69355 |
| | 0.25694 | 5.04378 | 1.51350 | 0.61958 | 0.77255 | 0.49264 | 0.94421 | | | |
| | 2.71212 | 5.19931 | 2.78839 | 2.40428 | 4.26104 | 1.59320 | 3.78292 | 3.88066 | 2.51191 | 3.48601 |

Fig. 15 cont.

| X | N | P | Q | R | S | T | V | W | Y | |
|---|---|---|---|---|---|---|---|---|---|---|
| 4.24692 | 2.90349 | 2.73742 | 3.18148 | 2.89790 | 2.37881 | 2.77522 | 2.98506 | 4.58479 | 3.61505 | |
| 3.15785 | 4.04180 | 4.40951 | 4.10090 | 3.99342 | 3.02807 | 3.06994 | 2.25721 | 4.40929 | 3.49824 | 97 |
| 4.24682 | 2.90349 | 2.73741 | 3.18135 | 2.89802 | 2.37882 | 2.77521 | 2.98520 | 4.58478 | 3.61505 | |
| 4.17285 | 3.01284 | 4.04987 | 2.84570 | 2.88511 | 2.58721 | 2.76934 | 3.63503 | 5.74599 | 4.18535 | 100 |
| 4.24690 | 2.90347 | 2.73739 | 3.18146 | 2.89801 | 2.37887 | 2.77519 | 2.98518 | 4.58477 | 3.61503 | |
| 3.85869 | 3.24770 | 3.71256 | 2.90708 | 3.00500 | 2.87565 | 2.43220 | 2.89443 | 4.60860 | 3.53213 | 101 |
| 4.24690 | 2.90347 | 2.73739 | 3.18146 | 2.89801 | 2.37887 | 2.77519 | 2.98518 | 4.58477 | 3.61503 | |
| 4.20192 | 2.98052 | 3.75922 | 2.47339 | 2.77664 | 2.68186 | 3.04377 | 2.70153 | 5.80113 | 3.99003 | 102 |
| 4.24690 | 2.90347 | 2.73739 | 3.18146 | 2.89801 | 2.37887 | 2.77519 | 2.98518 | 4.58477 | 3.61503 | |
| 4.24104 | 3.05470 | 3.67733 | 2.93822 | 3.11378 | 2.56354 | 2.99478 | 3.66969 | 5.79699 | 3.80893 | 103 |
| 4.24690 | 2.90347 | 2.73739 | 3.18146 | 2.89801 | 2.37887 | 2.77519 | 2.98518 | 4.58477 | 3.61503 | |
| 4.08233 | 2.99382 | 3.48321 | 2.76798 | 2.81698 | 2.66103 | 2.84623 | 3.32582 | 5.65893 | 4.12855 | 104 |

Fig. 15 cont.

| # | A | C | D | E | F | G | H | I | K | L |
|---|---|---|---|---|---|---|---|---|---|---|
| 57 | 2.68613 | 4.42221 | 2.77503 | 2.73146 | 3.46376 | 2.40536 | 3.72502 | 3.29365 | 2.67765 | 2.69359 |
|  | 0.37908 | 1.16653 | 5.52149 | 1.12055 | 0.39467 | 0.30284 | 1.34216 | 2.10210 | 3.91374 | 2.48664 |
|  | 2.63600 | 4.18606 | 4.62066 | 3.73360 | 2.65691 | 4.07485 | 4.14758 | 3.29354 | 2.67741 | 1.48664 |
| 58 | 2.68618 | 4.42225 | 2.77519 | 2.73123 | 3.46354 | 2.40513 | 3.72494 | 3.29354 | 2.67741 | 2.69355 |
|  | 0.00976 | 5.03064 | 5.75299 | 0.61958 | 0.77255 | 0.45900 | 0.99945 | 4.52959 | 2.95444 | 4.03199 |
|  | 3.21952 | 5.73290 | 2.87743 | 2.66103 | 5.05019 | 3.72769 | 3.48898 | 3.29354 | 2.67741 | 2.69355 |
| 59 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.22872 | 2.75721 | 1.81522 |
|  | 2.39844 | 4.73136 | 3.43026 | 2.89431 | 3.86200 | 3.24946 | 3.74780 | 3.29354 | 2.67741 | 2.69355 |
| 60 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.35018 | 4.41381 | 3.01710 |
|  | 3.39895 | 4.51359 | 5.07631 | 4.58465 | 2.39785 | 4.60918 | 4.03563 | 3.29354 | 2.67741 | 2.69355 |
| 61 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.26705 | 2.75866 | 2.88679 |
|  | 1.77724 | 4.25531 | 3.42081 | 2.81097 | 4.04042 | 2.96925 | 3.99323 | 3.29354 | 2.67741 | 2.69355 |
| 62 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | 3.29354 | 2.67741 | 2.69355 |
|  | 3.69007 | 5.17799 | 5.28100 | 4.85573 | 2.33031 | 4.43761 | 4.28084 | 3.59437 | 4.67100 | 3.09264 |

Fig. 15 cont.

| N | M | P | Q | R | S | T | V | W | Y | |
|---|---|---|---|---|---|---|---|---|---|---|
| 4.24704 | 2.90328 | 2.73717 | 3.18096 | 2.89813 | 2.37861 | 2.77487 | 2.98527 | 4.58487 | 3.61510 | |
| 3.10395 | 4.10223 | 3.23329 | 3.61036 | 3.88626 | 3.20303 | 2.83207 | 2.22842 | 3.88972 | 3.45278 | 115 |
| 4.24690 | 2.90347 | 2.73739 | 3.18146 | 2.89801 | 2.37887 | 2.77519 | 2.98518 | 4.58477 | 3.61503 | |
| 4.82879 | 0.80075 | 4.31010 | 3.19231 | 3.35765 | 2.45139 | 3.51670 | 4.11971 | 6.18889 | 4.76485 | 116 |
| 4.24690 | 2.90347 | 2.73739 | 3.18146 | 2.89801 | 2.37887 | 2.77519 | 2.98518 | 4.58477 | 3.61503 | |
| 3.80609 | 3.31193 | 2.63181 | 3.18686 | 2.36848 | 2.85988 | 2.73569 | 2.95853 | 5.04200 | 4.03544 | 117 |
| 4.24690 | 2.90347 | 2.73739 | 3.18146 | 2.89801 | 2.37887 | 2.77519 | 2.98518 | 4.58477 | 3.61503 | |
| 3.75696 | 4.41880 | 4.94997 | 4.35701 | 4.47600 | 3.92744 | 3.73901 | 3.13185 | 4.38040 | 0.57419 | 118 |
| 4.24690 | 2.90347 | 2.73739 | 3.18146 | 2.89801 | 2.37887 | 2.77519 | 2.98518 | 4.58477 | 3.61503 | |
| 3.70531 | 3.20380 | 4.16392 | 2.59509 | 2.48632 | 2.37493 | 2.74598 | 2.83950 | 4.61465 | 4.17786 | 119 |
| 4.24690 | 2.90347 | 2.73739 | 3.18146 | 2.89801 | 2.37887 | 2.77519 | 2.98518 | 4.58477 | 3.61503 | |
| 2.58425 | 4.68951 | 5.15569 | 4.69301 | 4.69607 | 4.16450 | 4.09544 | 3.47506 | 4.47450 | 0.56530 | 120 |

Fig. 15 cont.

| RBM | | A | C | D | E | F | G | H | I | K | L |
|---|---|---|---|---|---|---|---|---|---|---|---|
| | 63 | 2.68618 | 4.42225 | 2.77519 | 2.73123 | 3.46354 | 2.40513 | 3.72494 | 3.29354 | 2.67741 | 2.69355 |
| | | 0.01039 | 5.04612 | 5.54714 | 0.61958 | 0.77255 | 0.48576 | 0.95510 | 2.86303 | 3.71166 | 2.50672 |
| | | 1.69222 | 2.32577 | 4.23785 | 3.83399 | 3.43463 | 3.40868 | 4.35265 | | | |
| | 64 | 2.68618 | 4.42225 | 2.77519 | 2.73123 | 3.46354 | 2.40513 | 3.72494 | 3.29354 | 2.67741 | 2.69355 |
| | | 0.00961 | 5.04534 | 5.76769 | 0.61958 | 0.77255 | 0.48434 | 0.95738 | 4.14947 | 2.49461 | 2.60798 |
| | | 2.63860 | 5.20988 | 2.87097 | 2.41062 | 4.39219 | 2.46089 | 3.45353 | | | |
| | 65 | 2.68618 | 4.42225 | 2.77519 | 2.73123 | 3.46354 | 2.40513 | 3.72494 | 3.29354 | 2.67741 | 2.69355 |
| | | 0.18683 | 5.04612 | 1.80800 | 0.61958 | 0.77255 | 0.48576 | 0.95510 | 3.29354 | 2.98067 | 3.67592 |
| | | 2.59958 | 4.02178 | 3.20689 | 2.89743 | 4.64548 | 1.95845 | 3.99913 | 4.08809 | | |
| | 66 | 2.68618 | 4.42225 | 2.77519 | 2.73123 | 3.46354 | 2.40513 | 3.72494 | 3.29354 | 2.67741 | 2.69355 |
| | | 0.01146 | 4.87074 | 5.59309 | 0.61958 | 0.77255 | 0.48576 | 1.34375 | 4.78657 | 3.15501 | 4.25784 |
| | | 3.19047 | 5.94823 | 1.62903 | 2.62361 | 5.27058 | 3.64688 | 4.23619 | | | |
| | 67 | 2.68618 | 4.42225 | 2.77519 | 2.73123 | 3.46354 | 2.40513 | 3.72494 | 3.29354 | 2.67741 | 2.69355 |
| | | 0.00960 | 5.04612 | 5.76846 | 0.61958 | 0.77255 | 0.48576 | 0.95510 | 4.16044 | 3.66891 | 3.83502 |
| | | 2.86846 | 4.90094 | 3.95099 | 3.63211 | 4.37461 | 3.49369 | 4.47422 | | | |
| | 68 | 2.68618 | 4.42225 | 2.77519 | 2.73123 | 3.46354 | 2.40513 | 3.72494 | 3.29354 | 2.67741 | 2.69355 |
| | | 0.01146 | 4.23968 | 4.81860 | 4.20928 | 3.36544 | 3.99841 | 4.35204 | 1.70918 | 4.01229 | 1.85014 |
| | | 2.83178 | | | | | | | | | |
| | 69 | 2.68618 | 4.42225 | 2.77519 | 2.73123 | 3.46354 | 2.40513 | 3.72494 | 3.29354 | 2.67741 | 2.69355 |
| | | 0.01336 | 5.04612 | 4.98601 | 0.61958 | 0.77255 | 0.48576 | 0.95510 | | | |

Fig. 15 cont.

| N | M | P | Q | R | S | T | U | V | W | Y | |
|---|---|---|---|---|---|---|---|---|---|---|---|
| 4.24690 | 2.90347 | 2.73739 | 3.18146 | 2.89801 | 2.37887 | 2.77519 | 2.98518 | 4.58477 | 3.61503 | | |
| 3.45017 | 3.98694 | 4.08371 | 3.89271 | 3.88606 | 3.15410 | 2.86600 | 1.58394 | 5.03058 | 3.83984 | 121 | |
| 4.24690 | 2.90347 | 2.73739 | 3.18146 | 2.89801 | 2.37887 | 2.77519 | 2.98518 | 4.58477 | 3.61503 | | |
| 3.78224 | 2.61115 | 2.84915 | 2.71555 | 2.63277 | 2.52825 | 3.02702 | 3.43204 | 4.94060 | 4.17151 | 122 | |
| 4.24690 | 2.90347 | 2.73739 | 3.18146 | 2.89801 | 2.37887 | 2.77519 | 2.98518 | 4.58477 | 3.61503 | | |
| 4.47274 | 1.17202 | 4.13988 | 3.30393 | 3.43796 | 2.74670 | 3.19124 | 3.65926 | 5.88672 | 4.55436 | 123 | |
| 4.24690 | 2.90347 | 2.73739 | 3.18146 | 2.89801 | 2.37887 | 2.77519 | 2.98518 | 4.58477 | 3.61503 | | |
| 5.05417 | 1.00959 | 4.35511 | 3.26764 | 3.54275 | 2.58190 | 3.55819 | 4.33840 | 6.40175 | 4.91841 | 124 | |
| 4.24690 | 2.90347 | 2.73739 | 3.18146 | 2.89801 | 2.37887 | 2.77519 | 2.98518 | 4.58477 | 3.61503 | | |
| 4.68261 | 3.89416 | 0.56451 | 3.85114 | 4.00006 | 2.85167 | 3.30317 | 3.48525 | 6.09808 | 4.85890 | 125 | |
| 4.24690 | 2.90347 | 2.73739 | 3.18146 | 2.89801 | 2.37887 | 2.77519 | 2.98518 | 4.58477 | 3.61503 | | |
| 3.32501 | 3.82001 | 4.46200 | 4.05818 | 4.04980 | 3.35378 | 2.70609 | 1.43320 | 4.94642 | 3.39354 | 126 | |
| 4.24690 | 2.90347 | 2.73739 | 3.18146 | 2.89801 | 2.37887 | 2.77519 | 2.98518 | 4.58477 | 3.61503 | | |

Fig. 15 cont.

| | A | C | D | E | F | G | H | I | K | L |
|---|---|---|---|---|---|---|---|---|---|---|
| 69 | 2.55401 | 5.24701 | 3.07355 | 2.63184 | 4.01066 | 2.84370 | 3.89103 | 3.63062 | 2.43629 | 3.38004 |
| 70 | 2.68618 | 4.42225 | 2.77519 | 2.73123 | 3.46354 | 2.40513 | 3.72494 | 3.29354 | 2.67741 | 2.69355 |
|  | 0.00964 | 5.04240 | 5.76475 | 0.61958 | 0.77255 | 0.47901 | 0.96599 | | | |
|  | 2.67669 | 4.53251 | 3.76039 | 3.39083 | 2.33664 | 3.66357 | 3.74034 | 2.95761 | 3.18588 | 2.26813 |
| 71 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.68667 | 4.18642 | 3.88642 | 3.43145 | 3.43465 | 3.88140 | 3.71650 | 1.97413 | 2.93895 | 2.60842 |
| 72 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 4.03108 | 6.53003 | 0.27230 | 2.97703 | 5.93695 | 4.03316 | 4.82905 | 5.72580 | 4.11541 | 5.17169 |
| 73 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.83522 | 5.11930 | 3.23350 | 2.64529 | 4.24950 | 3.69079 | 3.84822 | 3.72471 | 2.69393 | 3.06398 |
| 74 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.80821 | 6.12117 | 2.36511 | 2.56796 | 3.85814 | 3.58671 | 3.82414 | 3.78049 | 2.63756 | 2.25515 |
| 75 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 4.59592 | 4.64798 | 5.44671 | 5.50205 | 6.39468 | 6.06756 | 6.39463 | 6.39637 | 5.79486 | 5.01551 |
| 76 | 2.68618 | 4.42225 | 2.77519 | 2.73123 | 3.46354 | 2.40513 | 3.72494 | 3.29354 | 2.67741 | 2.69355 |
|  | 0.00960 | 5.04612 | 5.76846 | 0.61958 | 0.77255 | 0.48576 | 0.95510 | | | |
|  | 2.83803 | 4.64798 | 3.47841 | 2.73085 | 3.69489 | 3.58484 | 2.49762 | 3.11647 | 2.74996 | 1.61811 |
|  | 2.68618 | 4.42225 | 2.77519 | 2.73123 | 3.46354 | 2.40513 | 3.72494 | 3.29354 | 2.67741 | 2.69355 |
|  | 0.00648 | 5.04299 | | 0.61958 | 0.77255 | 0.00000 | | | | |

Fig. 15 cont.

| M | N | P | Q | R | S | T | V | W | Y | |
|---|---|---|---|---|---|---|---|---|---|---|
| 3.51320 | 1.94127 | 4.08878 | 2.91392 | 2.75239 | 2.42580 | 2.28725 | 3.36576 | 5.32589 | 4.08642 | 127 |
| 4.24690 | 2.90347 | 2.73739 | 3.18146 | 2.89801 | 2.37887 | 2.77519 | 2.98518 | 4.58477 | 3.61503 | |
| 3.23727 | 2.91396 | 4.32330 | 3.52663 | 2.90814 | 2.99904 | 3.08670 | 2.73946 | 2.44926 | 2.43441 | 128 |
| 4.24690 | 2.90347 | 2.73739 | 3.18146 | 2.89801 | 2.37887 | 2.77519 | 2.98518 | 4.58477 | 3.61503 | |
| 3.54160 | 3.52819 | 4.32469 | 3.48594 | 2.32872 | 2.60102 | 2.30462 | 1.83527 | 5.12573 | 3.64809 | 129 |
| 4.24690 | 2.90347 | 2.73739 | 3.18146 | 2.89801 | 2.37887 | 2.77519 | 2.98518 | 4.58477 | 3.61503 | |
| 6.16226 | 3.52807 | 4.76779 | 4.05526 | 4.84330 | 3.87843 | 4.40541 | 5.20798 | 7.10674 | 5.58509 | 130 |
| 4.24690 | 2.90347 | 2.73739 | 3.18146 | 2.89801 | 2.37887 | 2.77519 | 2.98518 | 4.58477 | 3.61503 | |
| 4.12518 | 3.22153 | 1.25462 | 2.32097 | 2.78669 | 2.67844 | 3.09925 | 3.30420 | 5.32307 | 4.28110 | 131 |
| 4.24690 | 2.90347 | 2.73739 | 3.18146 | 2.89801 | 2.37887 | 2.77519 | 2.98518 | 4.58477 | 3.61503 | |
| 4.09881 | 2.80582 | 4.10609 | 3.00020 | 3.12970 | 2.05727 | 2.08721 | 3.51697 | 4.97824 | 4.01126 | 132 |
| 4.24690 | 2.90347 | 2.73739 | 3.18146 | 2.89801 | 2.37887 | 2.77519 | 2.98518 | 4.58477 | 3.61503 | |
| 6.88845 | 5.61670 | 5.50890 | 6.03797 | 5.78817 | 4.81534 | 5.13866 | 5.73137 | 7.07668 | 6.57195 | 133 |
| 4.24690 | 2.90347 | 2.73739 | 3.18146 | 2.89801 | 2.37887 | 2.77519 | 2.98518 | 4.58477 | 3.61503 | |
| 3.17172 | 3.23795 | 4.20782 | 2.94927 | 2.87008 | 2.93602 | 2.95798 | 3.09644 | 4.76396 | 3.38895 | 134 |
| 4.24690 | 2.90347 | 2.73739 | 3.18146 | 2.89801 | 2.37887 | 2.77519 | 2.98518 | 4.58477 | 3.61503 | |

Fig. 15 cont.

METHODS AND MATERIALS FOR ENCAPSULATING PROTEINS

CROSS-REFERENCE TO RELATED APPLICATIONS

This application is a U.S. National Stage Application filed under 35 U.S.C. § 371 of International Application No. PCT/IB2014/060784, filed Apr. 17, 2014, which claims the benefit of New Zealand Application No. 609662, filed Apr. 19, 2013. Both of these applications are hereby incorporated by reference in their entireties.

TECHNICAL FIELD

The invention relates to various applications for encapsulated proteins.

BACKGROUND

The protection, delivery and controlled release of biologically active proteins have a wide variety of applications. Such applications range from use as biological reagents, therapeutics, anti-pest products, in tissue engineering and many others.

However, while various delivery approaches have been established, developing the ability to deliver proteins according to local environmental changes, e.g., pH remains highly challenging.

In practice it may be necessary to protect the protein, for example a therapeutic, from degradation due to chemical, physical, and biological factors in certain environments, before it is introduced into the target environment. Conversely, it may be necessary to protect a particular biological environment from the protein if the protein is, for example, a targeted toxin.

There are various drawbacks with present encapsulation methods. For example, growth factors are widely used in tissue engineering applications to induce and guide blood vessel formation. However, their incorporation into protective matrices such as hydrogel scaffolds can results in a reduction in activity due to reactions such as cross-linking.

There is thus a general need for methods and materials that can protect proteins from certain environments, while simultaneously allowing them to be released and functional in other environments.

It is therefore an object of the invention to provide improved methods and materials useful for encapsulating proteins, advantageously with options for controlled release of the encapsulated protein, and/or at least to provide the public with a useful choice.

SUMMARY OF THE INVENTION

Method

In the first aspect the invention provides method for encapsulating a protein of interest, the method comprising the step of expressing a fusion protein comprising an N-terminal region of a rearrangement hot spot (RHS)-repeat-containing protein fused to the protein of interest.

In one embodiment the fusion protein is expressed in a cell.

Cleavage of Protein of Interest

In a further embodiment, upon expression and folding of the fusion protein, the protein of interest is cleaved from N-terminal region of the RHS-repeat-containing protein.

In a further embodiment cleavage is affected by the action of a protease intrinsic to the N-terminal region of the RHS-repeat containing protein.

In a further embodiment the protease is an aspartate protease.

Encapsulation of Protein of Interest

In a further embodiment the protein of interest is encapsulated by a shell comprising the N-terminal region of the RHS-repeat-containing protein.

Shell

In a further embodiment the shell is hollow.

In a further embodiment the shell is formed from one long strip of β-sheet, or β-sheets, that wraps around a central cavity.

In a further embodiment the β-sheet is composed of at least 50 β-strands, preferably at least 60 β-strands, preferably at least 70 β-strands, preferably at least 80 β-strands, preferably at least 90 derived from the N-terminal region of the RHS-repeat-containing protein.

In a further embodiment the shell includes a β-sheet formed from between 60 and 90 β-strands, preferably between 70 and 80, preferably about 76, and most preferably 76 of the β-strands.

In a further embodiment the central cavity is: between 30 and 55, preferably between 35 and 50, preferably between 40 and 44, preferably about 42, preferably 42 Å wide.

In a further embodiment the central cavity is: between 75 and 100, preferably between 80 and 95, preferably between 85 and 90, preferably about 87, preferably 87 Å long.

In a further embodiment the central cavity has a total enclosed volume of between 45,000 and 75,000, preferably between 50,000 and 70,000, preferably between 55,000 and 65,000, preferably about 59,000, preferably 59,000 Å$^3$.

In a further embodiment the shell is closed at both ends.

In a further embodiment the carboxy end of the shell is closed by an RHS-repeat-associated core domain.

In a further embodiment the RHS-repeat-associated core domain also acts as a protease.

In a further embodiment the overall shape of the shell is reminiscent of a hollow egg.

Protein of Interest (with any RHS)

In one embodiment the protein of interest is one that is normally naturally associated with the N-terminal region of the RHS-repeat-containing protein. That is the protein of interest is the naturally occurring C-terminal region of the RHS-repeat-containing protein.

In a preferred embodiment the protein of interest is one that is not normally naturally associated with the N-terminal region of the RHS-repeat-containing protein.

Thus in a preferred embodiment the protein of interest is heterologous the N-terminal region of the RHS-repeat-containing protein.

In a further embodiment the protein of interest is small enough to fit inside the shell.

In a further embodiment the protein of interest has a molecular weight of less than 103 kDa.

Preferably the molecular weight is less than 44 kDa. More preferably the molecular weight is less than 36 kDa.

RHS-Containing Protein

In one embodiment the RHS-repeat-containing protein is selected from a toxin complex C (TcC) component of a bacterial toxin complex, a non-toxin complex RHS-repeat containing protein, and a YD-repeat containing protein.

RHS-Repeat-Containing Protein is a Toxin Complex C (TcC) Component of a Bacterial Toxin Complex In one embodiment the RHS-containing protein is a toxin complex C (TcC) component of a bacterial toxin complex.

In a further embodiment fusion protein comprising the N-terminal region of the toxin complex C (TcC) component is co-expressed with a toxin complex B (TcB) component of a bacterial toxin complex.

Thus in one embodiment the invention provides method for encapsulating a protein of interest the method comprising the step of co-expressing:
  a) a toxin complex B (TcB) component of a bacterial toxin complex, and
  b) a fusion protein comprising an N-terminal region of a toxin complex C (TcC) component of a bacterial toxin complex fused to the protein of interest.

In one embodiment the a) and b) are expressed in a cell.

Protein of Interest

In one embodiment the protein of interest is one that is normally naturally associated with the the N-terminal region of a toxin complex C (TcC) component. That is the protein of interest is the naturally associated C-terminal region of a toxin complex C (TcC) component.

In a preferred embodiment the protein of interest is one that is not normally naturally associated with the N-terminal region of the toxin complex C (TcC) component.

Thus in a preferred embodiment the protein of interest is heterologous to the N-terminal region of the toxin complex C (TcC) component.

In a further embodiment the protein of interest is small enough to fit inside the shell.

In a further embodiment the protein of interest has a molecular weight of less than 40 kDa. Preferably the molecular weight is less than 35 kDa. More preferably the molecular weight is less than 32 kDa.

Cleavage of Protein of Interest

In a further embodiment the protein of interest is cleaved from N-terminal region of TcC component upon formation of a complex between the TcB and the fusion protein.

In a further embodiment cleavage is affected by the action of a protease intrinsic to the N-terminal region of TcC component.

In a further embodiment the protease is an aspartate protease.

In one embodiment the protease activity is encoded by an RHS-repeat associated core domain sequence.

In a further embodiment the RHS-repeat associated core domain sequence is as defined herein.

Encapsulation of Protein of Interest

In a further embodiment the protein of interest is encapsulated by a shell formed by a complex of the TcB component and the N-terminal region of the TcC.

Shell

In a further embodiment the shell is hollow.

In a further embodiment the shell is formed from one long strip of β-sheet, or β-sheets, that wraps around a central cavity.

In a further embodiment the β-sheet is composed of at least 50 β-strands, preferably at least 60 β-strands, preferably at least 70 β-strands, preferably at least 80 β-strands, preferably at least 90 derived from the TcB component and the N-terminal region of TcC.

In a further embodiment the shell includes a β-sheet formed from between 60 and 90 β-strands, preferably between 70 and 80, preferably about 76, and most preferably 76 of the β-strands.

In a further embodiment C-terminus of TcB and the N-terminus of the N-terminal region of TcC are in close proximity.

In a further embodiment C-terminus of TcB and the N-terminus of the N-terminal region of TcC are within 7.5 Å of each other.

In a further embodiment the central cavity is: between 30 and 55, preferably between 35 and 50, preferably between 40 and 44, preferably about 42, preferably 42 Å wide.

In a further embodiment the central cavity is: between 75 and 100, preferably between 80 and 95, preferably between 85 and 90, preferably about 87, preferably 87 Å wide.

In a further embodiment the central cavity has a total enclosed volume of between 45,000 and 75,000, preferably between 50,000 and 70,000, preferably between 55,000 and 65,000, preferably about 59,000, preferably 59,000 Å$^3$.

In a further embodiment the shell is closed at both ends.

In a further embodiment the shell includes β-propeller domain at the TcB end of the shell.

In a further embodiment the β-propeller domain is inserted into the loop between the 29$^{th}$ β-strand (β29) and the 51st β-strand (β51).

In one embodiment the β-propeller domain closes the TcB end of the shell.

In a further embodiment the shell includes an RHS-repeat-associated core domain at the TcC end of the shell.

In a further embodiment the RHS-repeat associated core domain is a short strip of β-sheet that spirals inwards at the TcC end of the shell.

In a further embodiment the RHS-repeat-associated core domain is formed by a region extending from the 45$^{th}$ β-strand (β45) to the 49th β-strand (β49).

In a further embodiment the RHS-repeat-associated core domain forms a plug.

In a further embodiment the RHS-repeat-associated core domain closes the TcC end of the shell.

In a further embodiment the plug closes the TcC end of the shell.

In a further embodiment the overall shape of the shell is reminiscent of a hollow egg.

Products

In a further aspect the invention provides an encapsulated protein of interest produced by the method of the invention.

In a further aspect the invention provides a protein of interest encapsulated by a shell formed by the N-terminal region of the RHS-repeat-containing protein.

In a further aspect the invention provides a protein of interest encapsulated by a shell formed by a complex of the TcB component and the N-terminal region of the TcC component.

In a further embodiment the invention provides a cell comprising an encapsulated protein according to the invention.

Compositions

In a further embodiment the invention provides a composition comprising an encapsulated protein of the invention or produced by a method of the invention.

In one embodiment the composition is an insecticidal composition. Preferably the composition has insecticidal activity. Preferably the composition comprises an agriculturally acceptable carrier.

In one embodiment the composition is a pharmaceutical composition. Preferably the composition has pharmaceutical activity. Preferably the composition comprises a pharmaceutically acceptable carrier.

Releasable Protein of Interest

In a further aspect the encapsulated protein is releasable or can be released, from the shell.

In a further aspect the encapsulated protein is releasable, can be released, or is released, from the shell in certain conditions.

In a further aspect the encapsulated protein is releasable, can be released, or is released, from the shell by lowering the pH of the environment surrounding the encapsulated protein.

In a further embodiment the encapsulated protein is releasable, can be released, or is released, from the shell by introducing the encapsulated protein into a low pH environment.

In one embodiment the encapsulated protein is releasable, can be released, or is released, when the pH is less than 5.5. Preferably the pH is less than 5.0. More preferably the pH is less than 4.5.

Release Method

In a further aspect the invention provides a method of controlled release of a protein of interest, the method comprising placing an encapsulated protein of the invention, or produced by the method of the invention, into an appropriate environment.

Preferably the appropriate environment affects release of the protein of interest.

In a further aspect the invention provides a method of controlled release of a protein of interest, the method comprising placing an encapsulated protein of the invention, or produced by the method of the invention, into a low pH environment.

In one embodiment the low pH environment has a pH of less than 5.5. Preferably the pH is less than 5.0. More preferably the pH is less than 4.5.

In a further embodiment the protein of interest is released by a conformational change in the shell encapsulating the protein of interest.

In one embodiment the pH-induced conformational change is opening of the shell resulting in release of the protein of interest.

In one embodiment the conformational change involves separation of the β-propeller blades allowing extrusion of an unfolded protein of interest through the middle of the propeller.

In one embodiment the conformational change is induced by a lowering of the pH environment of the encapsulated protein.

Method of Delivery of a Protein into a Low pH Environment

In a further aspect the invention provides a method of delivering a protein of interest to a low pH environment.

In one embodiment the low pH environment has a pH of less than 5.5. Preferably the pH is less than 5.0. More preferably the pH is less than 4.5.

In a further embodiment the low pH environment is the endosome of a cell.

In a further embodiment the low pH environment affects release of the encapsulated protein from the shell to deliver the protein of interest into the low pH environment.

In a further embodiment the low pH environment triggers delivery of the protein of interest into the cytosol of the cell.

In a further embodiment the protein of interest is released by a pH-induced conformational change in the shell encapsulating the protein of interest.

In a further embodiment the pH-induced conformational change is opening of the shell resulting in release of the protein of interest.

Method of Delivering a Protein of Interest into a Cell

In a further aspect the invention provides a method of delivering a protein of interest into a cell, the method comprising contacting the cell with and encapsulated protein of the invention.

In one embodiment delivery requires co-expression of a TcA component of a bacterial toxin complex.

Method of Controlling a Pest.

In a further embodiment the invention provides a method of controlling a pest, the method comprising contacting an encapsulated protein of the invention, or produced by a method of the invention, with the pest.

In one embodiment the pest is a pest of a plant.

In one embodiment the pest is an insect.

In this embodiment the protein of interest is a protein that is toxic to the insect.

In a further embodiment the pest is selected from the lepidoptera, coleoptera, diptera; and orthoptera.

In a further embodiment, the pest is selected from the following list:
1. *Antheraea eucalypti* Scott, 1864
2. *Bombyx mori* Linnaeus, 1758
3. *Cydia pomonella* Linnaeus 1758
4. *Drosophila melanogaster* Meigen, 1830
5. *Galleria melonella* Linnaeus, 1758
6. *Epiphyas postvittana* Walker, 1863
7. *Helicoverpa armigera* Hubner, 1805
8. *Heliothis virescens* Fabricius, 1777
9. *Helicoverpa zea* Boddie, 1850
10. *Heteronychus arator*
11. *Lymantria dispar* Linnaeus, 1758
12. *Mamestra brassicae* Linnaeus, 1758
13. *Manduca sexta* Linnaeus, 1763
14. *Pieris brassicae* Linnaeus, 1758
15. *Pieris rapae* Linnaeus, 1758
16. *Plutella xylostella* Linnaeus, 1758
17. *Spodoptera frugiperda* Smith 1797
18. *Spodoptera litura* Fabricius, 1775
19. *Tribolium castaneum* Herbst, 1797
20. *Trichoplusia ni* Hübner 1803

In a further embodiment the pest is selected from the *Odontria, Papuana, Peticoptus, Pyronola, Wiseana*, and *Costelytra*.

In a further embodiment the pest is a Nematode.

In a further embodiment the Nematode is from the genus *Heterorhabditis*.

Method Involving Expression in a Plant

In one embodiment the encapsulated protein is produced in the plant by expressing in the plant a fusion protein comprising an N-terminal region of a rearrangement hot spot (RHS)-repeat-containing protein fused to the protein of interest.

In a further embodiment the encapsulated protein is produced in the plant by co-expressing in the plant:
 a) a toxin complex B (TcB) component of a bacterial toxin complex, and
 b) a fusion protein comprising an N-terminal region of a toxin complex C (TcC) component of a bacterial toxin complex fused to the protein of interest.

In one embodiment the method requires co-expression of a TcA component of a bacterial toxin complex.

In a further embodiment the pest is contacted by the encapsulated protein produced in the plant.

In one embodiment the pest is contacted when it ingests the encapsulated protein.

Producing Insect Resistant Plant

In a further embodiment the method provides a method for producing an insect resistant plant the method comprising expressing in the plant a fusion protein comprising an N-terminal region of a rearrangement hot spot (RHS)-repeat-containing protein fused to the protein of interest.

In a further embodiment the method provides a method for producing an insect resistant plant the method comprising co-expressing in the plant:
 a) a toxin complex B (TcB) component of a bacterial toxin complex, and
 b) a fusion protein comprising an N-terminal region of a toxin complex C (TcC) component of a bacterial toxin complex fused to the protein of interest.

In one embodiment the method requires co-expression of a TcA component of a bacterial toxin complex.

DETAILED DESCRIPTION OF THE INVENTION

The applicants have elucidated for the first time the 3-dimensional structure produced by interaction of the TcB and TcC components of bacterial toxic complexes. The applicants describe how these components assemble to form a large hollow shell that encapsulates and sequesters the cytotoxic carboxy-terminal section of TcC. Furthermore, the applicants describe how TcC auto-proteolyses when folded in complex with TcB. TcC is an example of a protein that contains RHS (rearrangement hot spot) repeats. The applicants have also provided the first 3-dimensional structure for any RHS-repeat-containing protein. The applicant's data illustrates a structural architecture that is likely to be conserved across both this widely distributed bacterial RHS-repeat-containing protein family and the eukaryotic YD-repeat-containing protein family (which they show is a sub-set of the broader class of RHS-repeat-containing proteins). In addition to indicating the function of these protein families, the applicants provide a generic mechanism for protein encapsulation and delivery. This is described in detail in Example 1.

These discoveries have allowed the applicants to invent the methods and compositions of the invention which relate to encapsulating any protein of interest by expressing fusion proteins comprising the N-terminal region of an RHS-repeat-containing protein fused to a protein of interest.

In one embodiment the method involves co-expressing the TcB component and a fusion protein consisting of an N-terminal region of the TcC component fused to the protein of interest.

There are multiple applications for technology of the invention. Such applications form further aspects and embodiments of the invention as described herein.

In this specification where reference has been made to patent specifications, other external documents, or other sources of information, this is generally for the purpose of providing a context for discussing the features of the invention. Unless specifically stated otherwise, reference to such external documents is not to be construed as an admission that such documents, or such sources of information, in any jurisdiction, are prior art, or form part of the common general knowledge in the art.

The term "comprising" as used in this specification means "consisting at least in part of". When interpreting each statement in this specification that includes the term "comprising", features other than that or those prefaced by the term may also be present. Related terms such as "comprise" and "comprises" are to be interpreted in the same manner. In some embodiments, the term "comprising" (and related terms such as "comprise and "comprises") can be replaced by "consisting of" (and related terms "consist" and "consists").

Definitions

Rearrangement Hot Spot (RHS)-Repeat-Containing Protein

The term "rearrangement hot spot (RHS)-repeat-containing protein" or "RHS-repeat-containing protein" as used herein means a protein with an amino acid sequence that contains RHS repeats.

As used herein, the term "RHS-repeat-containing protein" includes toxin complex C (TcC) component of a bacterial toxin complex, a non-toxin-complex RHS-repeat containing proteins, and a YD-repeat containing proteins.

In one embodiment the RHS repeats conform to the profile-hidden Markov model (HMM) as described in the file YD_RHS_combined_JackHMMER.hmm (FIG. 14)

In a further embodiment the RHS repeats conform to the profile-HMM as described in the file RHS_repeat_pf05593.hmm (FIG. 12).

In a further embodiment the RHS repeats conform to the profile-HMM as described in the file YD_repeat_TIGR01643.HMM. (FIG. 13). The proteins of this embodiment are of the YD repeat class of RHS-repeat containing proteins.

Profile Hidden Markov Model (Profile HMM)

Profile HMMs turn a multiple sequence alignment into a position-specific scoring system suitable for searching databases for remotely homologous sequences. Profile HMM analyses complement standard pairwise comparison methods for large-scale sequence analysis.

In a further embodiment the RHS repeats conform with the consensus GxxxRYxYDxxGRL(I/T) [Wang et al., 1998].

RHS-repeat containing proteins typically contain 2-60 RHS repeats.

In one embodiment the RHS-repeat containing proteins as used in the methods and products of the invention contain at least 5, preferably at least 20, more preferably at least 30 RHS repeats.

In a further embodiment the RHS-repeat containing proteins as used in the methods and products of the invention contain at between 5 and 60, preferably between 15 and 50, more preferably between 35 and 45 RHS repeats.

In one embodiment the RHS-containing protein is selected from a toxin complex C (TcC) component of a bacterial toxin complex, a non-toxin complex RHS containing protein, and a YD-repeat containing protein.

Non-Toxin-Complex RHS-Repeat Containing Proteins

In addition to YD-repeat containing proteins, there are a number of other non-toxin-complex RHS-repeat containing protein including RhsA (McNulty et al., 2006).

YD-Repeat Containing Proteins

There are a number of other non-toxin-complex YD-repeat containing protein including teneurins (Tucker & Chiquet-Ehrismann, 2006), RHS Repeat Associated-Core Domain In addition to possessing RHS repeats, RHS repeat containing proteins also typically contain an "RHS repeat-associated core domain".

In one embodiment the RHS repeat containing proteins as used in the methods and products of the invention contain an RHS repeat-associated core domain.

The RHS repeat associated core domain is highly conserved, ~76 amino acids in length, and has aspartic peptidase activity as described here. The RHS repeat associated core domain conforms to the profile-HMM in file RHS_associated_core_domain_TIGR03696.HMM (FIG. 15)

Further description of the RHS repeat-associated core domain can be found at www<dot>ebi<dot>ac<dot>uk/interpro/entry/IPR022385.

In a further embodiment the RHS repeat-associated core domain is defined by performing an alignment between the RHS repeat containing protein sequence and the profile-HMM of the RHS repeat-associated core domain (RHS_associated_core_domain_TIGR03696.HMM—FIG. 15), using a program such as hmmalign.

Fusion of the Protein of Interest to the N-Terminal Region of the RHS Repeat Containing Protein The protein of interest will be joined at the C-terminal end of the RHS repeat-associated core domain. The final residues of the conserved RHS-associated core domain are generally "DxxGx", and when expressed cleavage will occur after the residue following the glycine.

In one embodiment the protease activity, intrinsic to the RHS repeat-containing protein, is encoded by the RHS repeat-associated core domain sequence.

In one embodiment the RHS-containing protein is selected from a toxin complex C (TcC) component of a bacterial toxin complex, a non-toxin complex RHS repeat-containing protein, and a YD-repeat containing protein.

Bacterial Toxin Complex

The term "bacterial toxin complex" refers to the large, multi-subunit toxin complexes (Tc) produced by some bacteria. Bacterial toxin complexes are of interest due to their potent oral insecticidal activity. They are composed of at least three toxin complex proteins, TcA, TcB and TcC, which are considered to be required to assemble together in order to be fully toxic.

Toxin Complex A (TcA) Component of a Bacterial Toxin Complex

Examples of TcA components are listed in the Table 1 below. The sequences as indicated in the table are provided in the sequence listing.

TABLE 1

TcA component sequences

| Species | Reference | Polypeptide SEQ ID NO: | Polynucleotide SEQ ID NO: |
|---|---|---|---|
| Yersinia entomophaga | YenA1 | 1 | 71 |
| Yersinia entomophaga | YenA2 | 2 | 72 |

TABLE 1-continued

TcA component sequences

| Species | Reference | Polypeptide SEQ ID NO: | Polynucleotide SEQ ID NO: |
|---|---|---|---|
| Xenorhabdus bovienii SS-2004 | XptA2 | 3 | 73 |
| Photorhabdus luminescens | TccA | 4 | 74 |
| Burkholderia pseudomallei | | 5 | 75 |
| Burkholderia pseudomallei 406e | TcdA1 | 6 | 76 |
| Yersinia pseudotuberculosis | TcaB | 7 | 77 |
| Yersinia pestis KIM10+ | | 8 | 78 |
| Serratia entomophila | SepA | 9 | 79 |
| Bacillus thuringiensis IBL 200 | TcaB | 10 | 80 |

Toxin Complex B (TcB) Component of a Bacterial Toxin Complex

Examples of TcB components, which can be used in the methods and compositions of the invention, are listed in the Table 2 below. The sequences, as indicated in the table, are provided in the sequence listing.

TABLE 2

TcB component sequences

| Species | Reference | Polypeptide SEQ ID NO: | Polynucleotide SEQ ID NO: |
|---|---|---|---|
| Yersinia entomophaga | YenB | 11 | 81 |
| Xenorhabdus bovienii SS-2004 | TcaC | 12 | 82 |
| Photorhabdus luminescens | TcaC | 13 | 83 |
| Burkholderia pseudomallei | TcdB1 | 14 | 84 |
| Burkholderia pseudomallei | TcdB2 | 15 | 85 |
| Yersinia pseudotuberculosis | | 16 | 86 |
| Yersinia pestis KIM10+ | TcaC1 | 17 | 87 |
| Serratia entomophila | SepB | 18 | 88 |
| Bacillus thuringiensis IBL 200 | TcaC | 19 | 89 |

In one embodiment the TcB component is from a species selected from those listed in Table 2.

In a further embodiment the TcB component has an amino acid sequence with at least 70% identity to a sequence selected from any one of SEQ ID NO:11 to SEQ ID NO:19.

In a further embodiment the TcB component has an amino acid sequence selected from any one of SEQ TD NO:11 to SEQ ID NO:19.

In a further embodiment the TcB component is encoded by a sequence with at least 70% identity to a sequence selected from any one of SEQ ID NO:81 to SEQ ID NO:89.

In a further embodiment the TcB component is encoded by a sequence selected from any one of SEQ ID NO:81 to SEQ ID NO:89.

In a further embodiment the TcB component is from Yersinia entomophaga.

In a further embodiment the TcB component has a sequence with at least 70% sequence identity to SEQ TD NO:11.

In a further embodiment the TcB component has the sequence of SEQ TD NO:11.

In a further embodiment the TcB component is encoded by a sequence with at least 70% sequence identity to SEQ ID NO:81

In a further embodiment the TcB component is encoded by the sequence of SEQ ID NO:81.

Toxin Complex C (TcC) Component of a Bacterial Toxin Complex

Examples of TcC components, which can be used in the methods and compositions of the invention, are listed in the Table 3 below. The sequences, as indicated in the table, are provided in the sequence listing.

TABLE 3

TcC component sequences

| Species | Reference | Polypeptide SEQ ID NO: | Polynucleotide SEQ ID NO: |
|---|---|---|---|
| Yersinia entomophaga | YenC1 | 20 | 90 |
| Yersinia entomophaga | YenC2 | 21 | 91 |
| Xenorhabdus bovienii SS-2004 | TccC | 22 | 92 |
| Photorhabdus luminescens | TccC | 23 | 93 |
| Burkholderia pseudomallei | TccC4 | 24 | 94 |
| Yersinia pseudotuberculosis | | 25 | 95 |
| Yersinia pestis KIM10+ | | 26 | 96 |
| Serratia entomophila | SepC | 27 | 97 |
| Bacillus thuringiensis IBL 200 | TccC | 28 | 98 |
| Bacillus thuringiensis IBL 200 | TccC2 | 29 | 99 |

In one embodiment the TcC component is from a species selected from those listed in Table 3.

In a further embodiment the TcC component has an amino acid sequence with at least 70% identity to a sequence selected from any one of SEQ ID NO:20 to 29.

In a further embodiment the TcC component has an amino acid sequence selected from any one of SEQ ID NO:20 to 29.

In a further embodiment the TcC component is encoded by a sequence with at least 70% identity to a sequence selected from any one of SEQ ID NO:90 to 29.

In a further embodiment the TcC component is encoded by a sequence selected from any one of SEQ ID NO:90 to 99.

In a further embodiment the TcC component is from *Yersinia entomophaga*.

In a further embodiment the TcC component has a sequence with at least 70% sequence identity to SEQ ID NO:21

In a further embodiment the TcC component has the sequence of SEQ ID NO:21.

In a further embodiment the TcC component is encoded by a sequence with at least 70% sequence identity to SEQ ID NO:91

In a further embodiment the TcC component is encoded by the sequence of SEQ ID NO:91.

N-Terminal Region of a Toxin Complex C (TcC) Component of a Bacterial Toxin Complex In a further embodiment the N-terminal region of the TcC component extends from the N-terminus to the amino acid following the final conserved glycine in the RHS-repeat-associated core domain.

In a further embodiment the variable carboxy-terminal domain of TcC proteins (uspstream of the final conserved glycine in the RHS-repeat-associated core domain) is replaced by the protein of interest in the fusion protein.

Examples of the TcC components, which can be used in the methods and compositions of the invention, are listed in the Table 4 below. The sequences, as indicated in the table, are provided in the sequence listing.

TABLE 4

N-teminal region of TcC component sequences

| Species | Reference | Polypeptide SEQ ID NO: | Polynucleotide SEQ ID NO: |
|---|---|---|---|
| Yersinia entomophaga | YenC1 - N term | 30 | 100 |
| Yersinia entomophaga | YenC2 - N term | 31 | 101 |

In a further embodiment the N-terminal region of the TcC component is selected from a species listed in Table 4.

In a further embodiment the N-terminal region of the TcC component has an amino acid sequence with at least 70% identity to a sequence selected from SEQ ID NO: 30 and 31.

In a further embodiment the N-terminal region of the TcC component has an amino acid sequence selected from SEQ ID NO: 30 and 31.

In a further embodiment the N-terminal region of the TcC component is from *Yersinia entomophaga*.

In a further embodiment the N-terminal region of the TcC component has a sequence with at least 70% identity to the sequence of SEQ ID NO: 31

In a further embodiment the N-terminal region of the TcC component has the sequence of SEQ ID NO: 31.

In a further embodiment the N-terminal region of the TcC component is encoded by a sequence with at least 70% identity to the sequence of SEQ ID NO: 101

In a further embodiment the N-terminal region of the TcC component is encoded by the sequence of SEQ ID NO: 101.

Naturally Occurring TcB-TcC Fusion Proteins

In some cases rather than TcB and TcC being encoded separately, a single ORF encodes an apparent TcB-TcC fusion protein. An example of this is the tcdB2 ORF of *Burkholderia rhizoxinica*.

Such naturally occurring TcB-TcC fusion proteins are intended to be encompassed by the term RHS repeat-containing proteins for use in the methods and compositions of the invention.

Other RHS-Repeat Containing Proteins Including YD-Repeat Containing Proteins

TABLE 5

RHS-repeat-containing proteins (including YD-repeat-containing proteins).

| Species | Reference | Polypeptide SEQ ID NO: | Polynucleotide SEQ ID NO: |
|---|---|---|---|
| Acidovorax avenae | | 32 | 102 |
| Acidovorax citrulli | | 33 | 103 |
| Bacillus cereus | wall-associated protein | 34 | 104 |
| Bacteroides thetaiotaomicron | cell wall-associated protein | 35 | 105 |
| Caenorhabditis elegans | Teneurin-1 | 36 | 106 |

TABLE 5-continued

RHS-repeat-containing proteins (including YD-repeat-containing proteins).

| Species | Reference | Polypeptide SEQ ID NO: | Polynucleotide SEQ ID NO: |
|---|---|---|---|
| *Cellvibrio japonicus* | RHS Repeat-containing protein | 37 | 107 |
| *Chloroflexus* sp. Y-400-fl | YD repeat-containing protein | 38 | 108 |
| *Corynebacterium matruchotii* | RHS Repeat-containing protein | 39 | 109 |
| *Desulfatibacillum alkenivorans* | Dalk_1487 | 40 | 110 |
| *Dickeya zeae* | YD repeat-containing protein | 41 | 111 |
| *Escherichia coli* | Rhs core protein with extension | 42 | 112 |
| *Escherichia coli* | core protein | 43 | 113 |
| *Escherichia coli* | rhsA | 44 | 114 |
| *Frankia* symbiont of *Datisca glomerata* | RHS Repeat-contaiing protein | 45 | 115 |
| *Frankia* sp. EuI1c | FraEuI1c_2129 | 46 | 116 |
| *Geobacter metallireducens* | RHS repeat protein | 47 | 117 |
| *Kitasatosphora seta* | KSE_13070 | 48 | 118 |
| *Methanosarcina acetivorans* | MA2045 | 49 | 119 |
| *Microbacterium testaceum* | Rhs family protein | 50 | 120 |
| *Pantoea ananatis* | RhsD | 51 | 121 |
| *Parachlamydia acanthamoebae* | pah_c013o039 | 52 | 122 |
| bacterium Ellin514 | YD repeat-containing protein | 53 | 123 |
| *Pelobacter propionicus* | YD repeat-containing protein | 54 | 124 |
| *Prevotella denticola* | RHS repeat protein | 55 | 125 |
| *Prevotella denticola* F0289 | RHS repeat protein | 56 | 126 |
| *Prevotella pallens* | HMPREF9144_1455 | 57 | 127 |
| *Prevotella pallens* | HMPREF9144_2442 | 58 | 128 |
| *Prevotella salivae* | conserved hypothetical protein | 59 | 129 |
| *Prevotella* sp. | conserved hypothetical protein | 60 | 130 |
| *Salmonella enterica* | RHS Repeat family protein | 61 | 131 |
| *Salmonella enterica* | RhsG | 62 | 132 |
| *Sorangium cellulosum* | RhsA | 63 | 133 |
| *Sorangium cellulosum* | Rhs family protein | 64 | 134 |
| *Streptomyces bingchenggensis* | Rhs protein | 65 | 135 |
| *Streptomyces clavuligerus* | YD repeat-containing protein | 66 | 136 |
| *Streptomyces griseoflavus* | conserved hypothetical protein | 67 | 137 |
| *Streptomyces violaceusniger* | RHS repeat protein | 68 | 138 |
| *Verrucomicrobium spinosum* | YD repeat protein | 69 | 139 |
| *Homo sapiens* | teneurin-1 isoform 1 | 70 | 140 |

In one embodiment the RHS-repeat-containing protein is from a species selected from those listed in Table 3.

In a further embodiment the RHS-repeat-containing protein has an amino acid sequence with at least 70% identity to a sequence selected from any one of SEQ ID NO: 33 to 70.

In a further embodiment the RHS-repeat-containing protein has an amino acid sequence selected from any one of SEQ ID NO: 33 to 70.

In a further embodiment the RHS-repeat-containing protein is encoded by a sequence with at least 70% identity to a sequence selected from any one of SEQ ID NO: 102 to 140.

In a further embodiment the RHS-repeat-containing protein is encoded by a sequence selected from any one of SEQ ID NO: 102 to 140.

Fusion Protein

The term "fusion protein" means a head to tail fusion of two proteins. In a fusion protein, the C-terminus of a first protein is covalently linked to the N-terminus of a second protein through peptide bonding.

In a further embodiment the fusion proteins according to the invention, the C-terminus of N-terminal region of RHS-repeat-containing protein is fused to the N-terminus of protein of interest.

In a further embodiment the fusion proteins according to the invention, the C-terminus of N-terminal region of the TcB component is fused to the N-terminus of protein of interest.

Methods for producing fusion proteins are well known to those skilled in the art. Typically, a fusion protein is produced by expression of a polynucleotide encoding the fusion protein. In that case, polynucleotide sequences encoding each portion of the fusion protein are themselves fused.

Protein of Interest

The term "protein of interest" refers to any protein to be encapsulated in the methods or compositions of the invention.

In a preferred embodiment the protein of interest is of a size small enough to fit within the hollow shell.

The protein of interest may be usefully selected from a toxin, a pharmaceutical, a biological reagent, and a bioactive polypeptide.

Expression

The encapsulated protein of the invention may be produced by in vitro transcription/translation by methods well-known to those skilled in the art.

Constructs and templates for transcription and translation may be produced by standard molecular biology techniques, such as cloning, or may be synthesised by methods well-known to those skilled in the art.

Alternatively the encapsulated protein of the invention may be produced by expression in a cell.

Cells

The cell used in the methods of the invention to express and produce the encapsulated protein may be any cell type.

In one embodiment the cell is a prokaryotic cell. In a further embodiment the cell is a eukaryotic cell. In one embodiment the cell is selected from a bacterial cell, a yeast cell, a fungal cell, an insect cell, algal cell, and a plant cell. In one embodiment the cell is a bacterial cell. In a further embodiment the cell is a yeast cell. In one embodiment the yeast cell is a *S. ceriviseae* cell. In further embodiment the cell is a fungal cell. In further embodiment the cell is an insect cell. In further embodiment the cell is an algal cell. In a further embodiment the cell is a plant cell.

In one embodiment the cell is a non-plant cell. In one embodiment the non-plant is selected from *E. coli, P. pastoris, S. ceriviseae, D. salina, C. reinhardtii*. In a further embodiment the non-plant is selected from *P. pastoris, S. ceriviseae, D. salina, C. reinhardtii*.

In yet another embodiment, the cell is a yeast cell. In yet another embodiment, the cell is a synthetic cell.

In a preferred embodiment the cell is a bacterial cell.

In a further embodiment the cell is a bacterial cell selected from the genera: *Yersinia, Photorhabdus, Xenorhabdus, Serratia* and *Rhizobium*.

Preferred *Yersinia* species include *Yersinia pestis, Yersinia pseudotuberculosis, Yersinia enterocolitica, Yersinia mollaretii, Yersinia frederiksenii* and *Yersinia entomophaga*

A preferred *Photorhabdus* species is *Photorhabdus luminescens*

A preferred *Xenorhabdus* species is *Xenorhabdus nematophilus*

Preferred *Serratia* species include *Serratia entomophila* and *Serratia proteamaculans.*

A preferred *Rhizobium* species is *Rhizobium pseudomonmas.*

Plants

The plant cells, and plants in which the encapsulated proteins are expressed may be from any plant species.

In one embodiment the plant cell or plant, is from a gymnosperm plant species.

In a further embodiment the plant cell or plant, is from an angiosperm plant species.

In a further embodiment the plant cell or plant, is from a from dicotyledonous plant species.

Preferred dicotyledonous genera include: *Amygdalus, Anacardium, Anemone, Arachis, Brassica, Cajanus, Cannabis, Carthamus, Carya, Ceiba, Cicer, Claytonia, Coriandrum, Coronilla, Corydalis, Crotalaria, Cyclamen, Dentaria, Dicentra, Dolichos, Eranthis, Glycine, Gossypium, Helianthus, Lathyrus, Lens, Lespedeza, Linum, Lotus, Lupinus, Macadamia, Medicago, Melilotus, Mucuna, Olea, Onobrychis, Ornithopus, Oxalis, Papaver, Phaseolus, Phoenix, Pistacia, Pisum, Prunus, Pueraria, Ribes, Ricinus, Sesamum, Thalictrum, Theobroma, Trifolium, Trigonella, Vicia* and *Vigna.*

Preferred dicotyledonous species include: *Amygdalus communis, Anacardium occidentale, Anemone americana, Anemone occidentalis, Arachis hypogaea, Arachis hypogea, Brassica napus Rape, Brassica nigra, Brassica campestris, Cajanus cajan, Cajanus indicus, Cannabis sativa, Carthamus tinctorius, Carya illinoinensis, Ceiba pentandra, Cicer arietinum, Claytonia exigua, Claytonia megarbiza, Coriandrum sativum, Coronilla varia, Corydalis flavula, Corydalis sempervirens, Crotalaria juncea, Cyclamen coum, Dentaria laciniata, Dicentra eximia, Dicentra formosa, Dolichos lablab, Eranthis hyemalis, Gossypium arboreum, Gossypium nanking, Gossypium barbadense, Gossypium berbaceum, Gossypium hirsutum, Glycine max, Glycine ussuriensis, Glycine gracilis, Helianthus annus, Lupinus angustifolius, Lupinus luteus, Lupinus mutabilis, Lespedeza sericea, Lespedeza striata, Lotus uliginosus, Lathyrus sativus, Lens culinaris, Lespedeza stipulacea, Linum usitatissimum, Lotus corniculatus, Lupinus albus, Medicago tribuloides, Macadamia integrifolia, Medicago arabice, Melilotus albus, Mucuna pruriens, Olea europaea, Onobrychis viciifolia, Ornithopus sativus, Oxalis tuberosa, Phaseolus aureus, Prunus cerasifera, Prunus cerasus, Phaseolus coccineus, Prunus domestica, Phaseolus lunatus, Prunus maheleb, Phaseolus acutifolius, Phoenix dactylifera, Pistacia vera, Pisum sativum, Prunus amygdalus, Prunus armeniaca, Pueraria thunbergiana, Ribes nigrum, Ribes rubrum, Ribes grossularia, Ricinus communis, Sesamum indicum, Thalictrum dioicum, Thalictrum flavum, Thalictrum thalictroides, Theobroma cacao, Trifolium augustifolium, Trifolium diffusum, Trifolium hybridum, Trifolium incarnatum, Trifolium ingrescens, Trifolium pratense, Trifolium repens, Trifolium resupinatum, Trifolium subterraneum, Trifolium alexandrinum, Trigonella foenumgraecum, Vicia angustifolia, Vicia atropurpurea, Vicia calcarata, Vicia dasycarpa, Vicia ervilia, Vaccinium oxycoccos, Vicia pannonica, Vigna sesquipedalis, Vigna sinensis, Vicia villosa, Vicia faba, Vicia sative* and *Vigna angularis.*

In a further embodiment the plant cell or plant, is from a monocotyledonous plant species.

Preferred monocotyledonous genera include: *Agropyron, Allium, Alopecurus, Andropogon, Arrhenatherum, Asparagus, Avena, Bambusa, Bellavalia, Brimeura, Brodiaea, Bulbocodium, Bothrichloa, Bouteloua, Bromus, Calamovilfa, Camassia, Cenchrus, Chionodoxa, Chloris, Colchicum, Crocus, Cymbopogon, Cynodon, Cypripedium, Dactylis, Dichanthium, Digitaria, Elaeis, Eleusine, Eragrostis, Eremurus, Erythronium, Fagopyrum, Festuca, Fritillaria, Galanthus, Helianthus, Hordeum, Hyacinthus, Hyacinthoides, Ipheion, Iris, Leucojum, Liatris, Lolium, Lycoris, Miscanthis, Miscanthus×giganateus, Muscari, Ornithogalum, Oryza, Panicum, Paspalum, Pennisetum, Phalaris, Phleum, Poa, Puschkinia, Saccharum, Secale, Setaria, Sorghastrum, Sorghum, Thinopyrum, Triticum, Vanilla, X Triticosecale Triticale* and *Zea.*

Preferred monocotyledonous species include: *Agropyron cristatum, Agropyron desertorum, Agropyron elongatum, Agropyron intermedium, Agropyron smithii, Agropyron spicatum, Agropyron trachycaulum, Agropyron trichophorum, Allium ascalonicum, Allium cepa, Allium chinense, Allium porrum, Allium schoenoprasum, Allium fistulosum, Allium sativum, Alopecurus pratensis, Andropogon gerardi, Andropogon Gerardii, Andropogon scoparious, Arrhenatherum elatius, Asparagus officinalis, Avena nuda, Avena sativa, Bambusa vulgaris, Bellevalia trifoliate, Brimeura amethystina, Brodiaea californica, Brodiaea coronaria, Brodiaea elegans, Bulbocodium versicolor, Bothrichloa barbinodis, Bothrichloa ischaemum, Bothrichloa saccharoides, Bouteloua curipendula, Bouteloua eriopoda, Bouteloua gracilis, Bromus erectus, Bromus inermus, Bromus*

*riparius, Calamovilfa longifilia, Camassia scilloides, Cenchrus ciliaris, Chionodoxa forbesii, Chloris gayana, Colchicum autumnale, Crocus sativus, Cymbopgon nardus, Cynodon dactylon, Cypripedium acaule, Dactylis glomerata, Dichanthium annulatum, Dichanthium aristatum, Dichanthium sericeum, Digitaria decumbens, Digitaria smutsii, Elaeis guineensis, Elaeis oleifera, Eleusine coracan, Elymus angustus, Elymus junceus, Eragrostis curvula, Eragrostis tef, Erenurus robustus, Erythronium elegans, Erythronium helenae, Fagopyrum esculentum, Fagopyrum tataricum, Festuca arundinacea, Festuca ovina, Festuca pratensis, Festuca rubra, Fritillaria cirrhosa, Galanthus nivalis, Helianthus annuus* sunflower, *Hordeum distichum, Hordeum vulgare, Hyacinthus orientalis, Hyacinthoides hispanica, Hyacinthoides non-scripta, Ipheion sessile, Iris collecttii, Iris danfordiae, Iris rericulate, Leucojum aestivum, Liatris cylindracea, Liatris elegans, Lolium longiflorum, Lolium multiflorum, Lolium perenne, Lolium westerwoldicum, Lolium hybridum, Lycoris radiata, Miscanthis sinensis, Miscanthis×giganteus, Muscari armeniacum, Muscari macrocarpum, Narcissus pseudonarcissus, Ornithogalum montanum, Oryza sativa, Panicum italicium, Panicum maximum, Panicum miliaceum, Panicum purpurascens, Panicum virgatum, Paspalum dilatatum, Paspalum notatum, Pennisetum clandestinum, Pennisetum glaucum, Pennisetum purpureum, Pennisetum spicatum, Phalaris arundinacea, Phleum bertolinii, Phleum pratense, Poa fendleriana, Poa pratensis, Poa nemoralis, Puschkinia scilloides, Saccharum officinarum, Saccharum robustum, Saccharum sinense, Saccharum spontaneum, Scilla autumnalis, Scilla peruviana, Secale cereale, Setaria italica, Setaria sphacelata, Sorghastrum nutans, Sorghum bicolor, Sorghum dochna, Sorghum halepense, Sorghum sudanense, Thinopyrum ponticum, Trillium grandifloran, Triticum aestivum, Triticum dicoccum, Triticum durum, Triticum monococcum, Tulipa batalinii, Tulipa clusiana, Tulipa dasystemon, Tulipa gesneriana, Tulipa greigii, Tulipa kaufmanniana, Tulipa sylvestris, Tulipa turkestanica, Vanilla fragans, X Triticosecale* and *Zea mays.*

Preferred plants include crop plants, such as cotton, sorghum, maize, wheat, rice, soy and barley.

Plant Parts, Propagues and Progeny

The term "plant" is intended to include a whole plant, any part of a plant, a seed, a fruit, propagules and progeny of a plant.

The term 'propagule' means any part of a plant that may be used in reproduction or propagation, either sexual or asexual, including seeds and cuttings.

The plants of the invention may be grown and either self-ed or crossed with a different plant strain and the resulting progeny, comprising the polynucleotides or constructs of the invention, and/or expressing the polypeptide sequences of the invention, also form an part of the present invention.

Preferably the plants, plant parts, propagules and progeny comprise a polynucleotide or construct of the invention, and/or express a polypeptide sequence of the invention.

The term "agriculturally acceptable carrier" covers all liquid and solid carriers known in the art such as water and oils, as well as adjuvants, dispersants, binders, wettants, surfactants, humectants tackifiers, formulation excipients, and the like that are ordinarily known for use in the preparation of control compositions, including insecticide compositions.

The phrase "insecticidal activity" means activity in at least one of: killing, slowing the growth of, preventing reproduction of, and reducing numbers of any given insect.

An "insect pest" is an insect that causes damage to a non-insect resistant plant.

The "pharmaceutical composition" includes the encapsulated protein of the invention or produced by the method of the invention.

The "pharmaceutical composition" may also include the use of formulation chemistry, including but not limited to methods described in: Pharmaceutical Formulation Development of Peptides and Proteins, Second Edition Published: Nov. 14, 2012 by CRC Press—392 Pages Editor(s): Lars Hovgaard, Novo Nordisk A/S, Malov, Denmark; Sven Frokjaer, University of Copenhagen, Denmark; Marco van de Weert, University of Copenhagen, Denmark.

The term "pharmaceutical" is intended to cover veterinary applications as well as human health application. Animal that may be treated for veterinary applications include agricultural animals such as cows, sheep, goats, pigs, horses, chickens, deer, as well as companion animals such as dogs, cats and rabbits.

Polynucleotides and Fragments

The term "polynucleotide(s)," as used herein, means a single or double-stranded deoxyribonucleotide or ribonucleotide polymer of any length but preferably at least 15 nucleotides, and include as non-limiting examples, coding and non-coding sequences of a gene, sense and antisense sequences complements, exons, introns, genomic DNA, cDNA, pre-mRNA, mRNA, rRNA, siRNA, miRNA, tRNA, ribozymes, recombinant polypeptides, isolated and purified naturally occurring DNA or RNA sequences, synthetic RNA and DNA sequences, nucleic acid probes, primers and fragments.

A "fragment" of a polynucleotide sequence provided herein is a subsequence of contiguous nucleotides.

The term "primer" refers to a short polynucleotide, usually having a free 3'OH group, that is hybridized to a template and used for priming polymerization of a polynucleotide complementary to the target.

The term "probe" refers to a short polynucleotide that is used to detect a polynucleotide sequence that is complementary to the probe, in a hybridization-based assay. The probe may consist of a "fragment" of a polynucleotide as defined herein.

Polypeptides and Fragments

The term "polypeptide", as used herein, encompasses amino acid chains of any length but preferably at least 5 amino acids, including full-length proteins, in which amino acid residues are linked by covalent peptide bonds. Polypeptides of the present invention, or used in the methods of the invention, may be purified natural products, or may be produced partially or wholly using recombinant or synthetic techniques.

A "fragment" of a polypeptide is a subsequence of the polypeptide that preferably performs a function of and/or provides three dimensional structure of the polypeptide. The term may refer to a polypeptide, an aggregate of a polypeptide such as a dimer or other multimer, a fusion polypeptide, a polypeptide fragment, a polypeptide variant, or derivative thereof capable of performing the above enzymatic activity.

The term "isolated" as applied to the polynucleotide or polypeptide sequences disclosed herein is used to refer to sequences that are removed from their natural cellular environment.

An isolated molecule may be obtained by any method or combination of methods including biochemical, recombinant, and synthetic techniques.

The term "recombinant" refers to a polynucleotide sequence that is removed from sequences that surround it in its natural context and/or is recombined with sequences that are not present in its natural context.

A "recombinant" polypeptide sequence is produced by translation from a "recombinant" polynucleotide sequence.

The term "derived from" with respect to polynucleotides or polypeptides being derived from a particular genera or species, means that the polynucleotide or polypeptide has the same sequence as a polynucleotide or polypeptide found naturally in that genera or species. The polynucleotide or polypeptide, derived from a particular genera or species, may therefore be produced synthetically or recombinantly.

Variants

As used herein, the term "variant" refers to polynucleotide or polypeptide sequences different from the specifically identified sequences, wherein one or more nucleotides or amino acid residues is deleted, substituted, or added. Variants may be naturally occurring allelic variants, or non-naturally occurring variants. Variants may be from the same or from other species and may encompass homologues, paralogues and orthologues. In certain embodiments, variants of the inventive polypeptides and polypeptides possess biological activities that are the same or similar to those of the inventive polypeptides or polypeptides. The term "variant" with reference to polypeptides and polypeptides encompasses all forms of polypeptides and polypeptides as defined herein.

Polynucleotide variants Variant polynucleotide sequences preferably exhibit at least 50%, more preferably at least 51%, more preferably at least 52%, more preferably at least 53%, more preferably at least 54%, more preferably at least 55%, more preferably at least 56%, more preferably at least 57%, more preferably at least 58%, more preferably at least 59%, more preferably at least 60%, more preferably at least 61%, more preferably at least 62%, more preferably at least 63%, more preferably at least 64%, more preferably at least 65%, more preferably at least 66%, more preferably at least 67%, more preferably at least 68%, more preferably at least 69%, more preferably at least 70%, more preferably at least 71%, more preferably at least 72%, more preferably at least 73%, more preferably at least 74%, more preferably at least 75%, more preferably at least 76%, more preferably at least 77%, more preferably at least 78%, more preferably at least 79%, more preferably at least 80%, more preferably at least 81%, more preferably at least 82%, more preferably at least 83%, more preferably at least 84%, more preferably at least 85%, more preferably at least 86%, more preferably at least 87%, more preferably at least 88%, more preferably at least 89%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, and most preferably at least 99% identity to a sequence of the present invention. Identity is found over a comparison window of at least 20 nucleotide positions, preferably at least 50 nucleotide positions, more preferably at least 100 nucleotide positions, and most preferably over the entire length of a polynucleotide of the invention.

Polynucleotide sequence identity can be determined in the following manner. The subject polynucleotide sequence is compared to a candidate polynucleotide sequence using BLASTN (from the BLAST suite of programs, version 2.2.5 [November 2002]) in bl2seq (Tatiana A. Tatusova, Thomas L. Madden (1999), "Blast 2 sequences—a new tool for comparing protein and nucleotide sequences", FEMS Microbiol Lett. 174:247-250), which is publicly available from the NCBI website on the World Wide Web ftp<dot>ncbi<dot>nih<dot>gov/blast/. The default parameters of bl2seq are utilized except that filtering of low complexity parts should be turned off.

The identity of polynucleotide sequences may be examined using the following unix command line parameters:

bl2seq -i nucleotideseq1 -j nucleotideseq2 -F F -p blastn

The parameter -F F turns off filtering of low complexity sections. The parameter -p selects the appropriate algorithm for the pair of sequences. The bl2seq program reports sequence identity as both the number and percentage of identical nucleotides in a line "Identities=".

Polynucleotide sequence identity may also be calculated over the entire length of the overlap between a candidate and subject polynucleotide sequences using global sequence alignment programs (e.g. Needleman, S. B. and Wunsch, C. D. (1970) J. Mol. Biol. 48, 443-453). A full implementation of the Needleman-Wunsch global alignment algorithm is found in the needle program in the EMBOSS package (Rice, P. Longden, I. and Bleasby, A. EMBOSS: The European Molecular Biology Open Software Suite, Trends in Genetics June 2000, vol 16, No 6. pp. 276-277) which can be obtained from the world wide web at www<dot>hgtnp<dot>mfc<dot>ac<dot>uk/Software/EMBOSS/. The European Bioinformatics Institute server also provides the facility to perform EMBOSS-needle global alignments between two sequences on line at www<dot>ebi<dot>ac<dot>uk/emboss/align/.

Alternatively the GAP program may be used which computes an optimal global alignment of two sequences without penalizing terminal gaps. GAP is described in the following paper: Huang, X. (1994) On Global Sequence Alignment. Computer Applications in the Biosciences 10, 227-235.

A preferred method for calculating polynucleotide % sequence identity is based on aligning sequences to be compared using Clustal X (Jeanmougin et al., 1998, Trends Biochem. Sci. 23, 403-5.)

Polynucleotide variants also encompass those which exhibit a similarity to one or more of the specifically identified sequences that is likely to preserve the functional equivalence of those sequences and which could not reasonably be expected to have occurred by random chance. Such sequence similarity with respect to polypeptides may be determined using the publicly available bl2seq program from the BLAST suite of programs (version 2.2.5 [November 2002]) from the NCBI website on the World Wide Web at ftp://ftp<dot>ncbi<dot>nih<dot>gov/blast/.

The similarity of polynucleotide sequences may be examined using the following unix command line parameters:

bl2seq -i nucleotideseq1 -j nucleotideseq2 -F F -p tblastx

The parameter -F F turns off filtering of low complexity sections. The parameter -p selects the appropriate algorithm for the pair of sequences. This program finds regions of similarity between the sequences and for each such region reports an "E value" which is the expected number of times one could expect to see such a match by chance in a database of a fixed reference size containing random sequences. The size of this database is set by default in the bl2seq program. For small E values, much less than one, the E value is approximately the probability of such a random match.

Variant polynucleotide sequences preferably exhibit an E value of less than $1\times10^{-6}$ more preferably less than $1\times10^{-9}$, more preferably less than $1\times10^{-12}$, more preferably less than $1\times10^{-15}$, more preferably less than $1\times10^{-18}$, more preferably less than $1\times10^{-21}$, more preferably less than $1\times10^{-30}$, more preferably less than $1\times10^{-40}$, more preferably less than 1×10-50, more preferably less than 1×10-60, more preferably less than 1×10-70, more preferably less than 1×10-80, more preferably less than 1×10-90 and most preferably less than 1×10-100 when compared with any one of the specifically identified sequences.

Alternatively, variant polynucleotides of the present invention, or used in the methods of the invention, hybridize to the specified polynucleotide sequences, or complements thereof under stringent conditions.

The term "hybridize under stringent conditions", and grammatical equivalents thereof, refers to the ability of a polynucleotide molecule to hybridize to a target polynucleotide molecule (such as a target polynucleotide molecule immobilized on a DNA or RNA blot, such as a Southern blot or Northern blot) under defined conditions of temperature and salt concentration. The ability to hybridize under stringent hybridization conditions can be determined by initially hybridizing under less stringent conditions then increasing the stringency to the desired stringency.

With respect to polynucleotide molecules greater than about 100 bases in length, typical stringent hybridization conditions are no more than 25 to 30° C. (for example, 10° C.) below the melting temperature (Tm) of the native duplex (see generally, Sambrook et al., Eds, 1987, Molecular Cloning, A Laboratory Manual, 2nd Ed. Cold Spring Harbor Press; Ausubel et al., 1987, Current Protocols in Molecular Biology, Greene Publishing,). Tm for polynucleotide molecules greater than about 100 bases can be calculated by the formula Tm=81.5+0.41% (G+C-log (Na+). (Sambrook et al., Eds, 1987, Molecular Cloning, A Laboratory Manual, 2nd Ed. Cold Spring Harbor Press; Bolton and McCarthy, 1962, PNAS 84:1390). Typical stringent conditions for polynucleotide of greater than 100 bases in length would be hybridization conditions such as prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

With respect to polynucleotide molecules having a length less than 100 bases, exemplary stringent hybridization conditions are 5 to 10° C. below Tm. On average, the Tm of a polynucleotide molecule of length less than 100 bp is reduced by approximately (500/oligonucleotide length)° C.

With respect to the DNA mimics known as peptide nucleic acids (PNAs) (Nielsen et al., Science. 1991 Dec. 6, 254(5037):1497-500) Tm values are higher than those for DNA-DNA or DNA-RNA hybrids, and can be calculated using the formula described in Giesen et al., Nucleic Acids Res. 1998 Nov. 1; 26(21):5004-6. Exemplary stringent hybridization conditions for a DNA-PNA hybrid having a length less than 100 bases are 5 to 10° C. below the Tm.

Variant polynucleotides used in the methods of the invention, also encompasses polynucleotides that differ from the sequences of the invention but that, as a consequence of the degeneracy of the genetic code, encode a polypeptide having similar activity to a polypeptide encoded by a polynucleotide of the present invention. A sequence alteration that does not change the amino acid sequence of the polypeptide is a "silent variation". Except for ATG (methionine) and TGG (tryptophan), other codons for the same amino acid may be changed by art recognized techniques, e.g., to optimize codon expression in a particular host organism.

Polynucleotide sequence alterations resulting in conservative substitutions of one or several amino acids in the encoded polypeptide sequence without significantly altering its biological activity are also included in the invention. A skilled artisan will be aware of methods for making phenotypically silent amino acid substitutions (see, e.g., Bowie et al., 1990, Science 247, 1306).

Variant polynucleotides due to silent variations and conservative substitutions in the encoded polypeptide sequence may be determined using the publicly available bl2seq program from the BLAST suite of programs (version 2.2.5 [November 2002]) from the NCBI website on the World Wide Web at ftp://ftp<dot>ncbi<dot>nih<dot>gov/blast/via the tblastx algorithm as previously described.

Polypeptide Variants

The term "variant" with reference to polypeptides encompasses naturally occurring, recombinantly and synthetically produced polypeptides. Variant polypeptide sequences preferably exhibit at least 50%, more preferably at least 51%, more preferably at least 52%, more preferably at least 53%, more preferably at least 54%, more preferably at least 55%, more preferably at least 56%, more preferably at least 57%, more preferably at least 58%, more preferably at least 59%, more preferably at least 60%, more preferably at least 61%, more preferably at least 62%, more preferably at least 63%, more preferably at least 64%, more preferably at least 65%, more preferably at least 66%, more preferably at least 67%, more preferably at least 68%, more preferably at least 69%, more preferably at least 70%, more preferably at least 71%, more preferably at least 72%, more preferably at least 73%, more preferably at least 74%, more preferably at least 75%, more preferably at least 76%, more preferably at least 77%, more preferably at least 78%, more preferably at least 79%, more preferably at least 80%, more preferably at least 81%, more preferably at least 82%, more preferably at least 83%, more preferably at least 84%, more preferably at least 85%, more preferably at least 86%, more preferably at least 87%, more preferably at least 88%, more preferably at least 89%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, and most preferably at least 99% identity to a sequences of the present invention. Identity is found over a comparison window of at least 20 amino acid positions, preferably at least 50 amino acid positions, more preferably at least 100 amino acid positions, and most preferably over the entire length of a polypeptide of the invention.

Polypeptide sequence identity can be determined in the following manner. The subject polypeptide sequence is compared to a candidate polypeptide sequence using BLASTP (from the BLAST suite of programs, version 2.2.5 [November 2002]) in bl2seq, which is publicly available from the NCBI website on the World Wide Web at ftp<dot>ncbi<dot>nih<dot>gov/blast/. The default parameters of bl2seq are utilized except that filtering of low complexity regions should be turned off.

Polypeptide sequence identity may also be calculated over the entire length of the overlap between a candidate and subject polynucleotide sequences using global sequence alignment programs. EMBOSS-needle (available at www<dot>ebi<dot>ac<dot>uk/emboss/align/) and GAP (Huang, X. (1994) On Global Sequence Alignment. Computer Applications in the Biosciences 10, 227-235.) as discussed above are also suitable global sequence alignment programs for calculating polypeptide sequence identity'.

A preferred method for calculating polypeptide % sequence identity is based on aligning sequences to be compared using Clustal X (Jeanmougin et al., 1998, Trends Biochem. Sci. 23, 403-5.)

Polypeptide variants used in the methods of the invention, also encompass those which exhibit a similarity to one or more of the specifically identified sequences that is likely to preserve the functional equivalence of those sequences and. which could not reasonably be expected to have occurred by random chance. Such sequence similarity with respect to polypeptides may be determined using the publicly available bl2seq program from the BLAST suite of programs (version 2.2.5 [November 20021) from the NCBI website on the World Wide Web at ftp<dot>ncbi<dot>nili<dot>gov/blast/. The similarity of polypeptide sequences may be examined using the following unix command line parameters:

bl2seq -i peptideseq1 -j peptideseq2 -F F -p blastp.

Variant polypeptide sequences preferably exhibit an E value of less than 1×10-6 more preferably less than 1×10-9, more preferably less than 1×10-12, more preferably less than 1×10-15, more preferably less than 1×10-18, more preferably less than 1×10-21, more preferably less than 1×10-30, more preferably less than 1×10-40, more preferably less than 1×10-50, more preferably less than 1×10-60, more preferably less than 1×10-70, more preferably less than 1×10-80, more preferably less than 1×10-90 and most preferably 1×10-100 when compared with any one of the specifically identified sequences.

The parameter -F F turns off filtering of low complexity sections. The parameter -p selects the appropriate algorithm for the pair of sequences. This program finds regions of similarity between the sequences and for each such region reports an "E value" which is the expected number of times one could expect to see such a match by chance in a database of a fixed reference size containing random sequences. For small E values, much less than one, this is approximately the probability of such a random match.

Conservative substitutions of one or several amino acids of a described polypeptide sequence without significantly altering its biological activity are also included in the invention. A skilled artisan will be aware of methods for making phenotypically silent amino acid substitutions (see, e.g., Bowie et al., 1990, Science 247, 1306).

Constructs, Vectors and Components Thereof

The term "genetic construct" refers to a polynucleotide molecule, usually double-stranded DNA, which may have inserted into it another polynucleotide molecule (the insert polynucleotide molecule) such as, but not limited to, a cDNA molecule. A genetic construct may contain the necessary elements that permit transcribing the insert polynucleotide molecule, and, optionally, translating the transcript into a polypeptide. The insert polynucleotide molecule may be derived from the host cell, or may be derived from a different cell or organism and/or may be a recombinant polynucleotide. Once inside the host cell the genetic construct may become integrated in the host chromosomal DNA. The genetic construct may be linked to a vector.

The term "vector" refers to a polynucleotide molecule, usually double stranded DNA, which is used to transport the genetic construct into a host cell. The vector may be capable of replication in at least one additional host system, such as *E. coli*.

The term "expression construct" refers to a genetic construct that includes the necessary elements that permit transcribing the insert polynucleotide molecule, and, optionally, translating the transcript into a polypeptide. An expression construct typically comprises in a 5' to 3' direction:

a) a promoter functional in the host cell into which the construct will be transformed, b) the polynucleotide to be expressed, and c) a terminator functional in the host cell into which the construct will be transformed.

The term "coding region" or "open reading frame" (ORF) refers to the sense strand of a genomic DNA sequence or a cDNA sequence that is capable of producing a transcription product and/or a polypeptide under the control of appropriate regulatory sequences. The coding sequence may, in some cases, identified by the presence of a 5' translation start codon and a 3' translation stop codon. When inserted into a genetic construct, a "coding sequence" is capable of being expressed when it is operably linked to promoter and terminator sequences.

"Operably-linked" means that the sequenced to be expressed is placed under the control of regulatory elements that include promoters, tissue-specific regulatory elements, temporal regulatory elements, enhancers, repressors and terminators.

The term "noncoding region" refers to untranslated sequences that are upstream of the translational start site and downstream of the translational stop site. These sequences are also referred to respectively as the 5' UTR and the 3' UTR. These regions include elements required for transcription initiation and termination, mRNA stability, and for regulation of translation efficiency.

Terminators are sequences, which terminate transcription, and are found in the 3' untranslated ends of genes downstream of the translated sequence. Terminators are important determinants of mRNA stability and in some cases have been found to have spatial regulatory functions.

The term "promoter" refers to nontranscribed cis-regulatory elements upstream of the coding region that regulate gene transcription. Promoters comprise cis-initiator elements which specify the transcription initiation site and conserved boxes such as the TATA box, and motifs that are bound by transcription factors. Introns within coding sequences can also regulate transcription and influence post-transcriptional processing (including splicing, capping and polyadenylation).

A promoter may be homologous with respect to the polynucleotide to be expressed. This means that the promoter and polynucleotide are found operably linked in nature.

In a preferred embodiment the promoter may be heterologous with respect to the polynucleotide to be expressed. This means that the promoter and the polynucleotide are not found operably linked in nature.

In certain embodiments the polynucleotides/polypeptides of the invention may be advantageously expressed under the control of selected promoter sequences as described below.

Vegetative Tissue Specific Promoters

An example of a vegetative specific promoter is found in U.S. Pat. Nos. 6,229,067; and 7,629,454; and 7,153,953; and 6,228,643.

Pollen Specific Promoters

An example of a pollen specific promoter is found in U.S. Pat. Nos. 7,141,424; and 5,545,546; and 5,412,085; and 5,086,169; and 7,667,097.

Seed Specific Promoters

An example of a seed specific promoter is found in U.S. Pat. Nos. 6,342,657; and 7,081,565; and 7,405,345; and 7,642,346; and 7,371,928. A preferred seed specific promoter is the napin promoter of *Brassica napus* (Josefsson et al., 1987, J Biol Chem. 262(25):12196-201; Ellerström et al., 1996, Plant Molecular Biology, Volume 32, Issue 6, pp 1019-1027).

Fruit Specific Promoters

An example of a fruit specific promoter is found in U.S. Pat. Nos. 5,536,653; and 6,127,179; and 5,608,150; and 4,943,674.

Non-Photosynthetic Tissue Preferred Promoters

Non-photosynthetic tissue preferred promoters include those preferentially expressed in non-photosynthetic tissues/organs of the plant.

Non-photosynthetic tissue preferred promoters may also include light repressed promoters.

Light Repressed Promoters

An example of a light repressed promoter is found in U.S. Pat. No. 5,639,952 and in U.S. Pat. No. 5,656,496.

Root Specific Promoters

An example of a root specific promoter is found in U.S. Pat. No. 5,837,848; and US 2004/0067506 and US 2001/0047525.

Tuber Specific Promoters

An example of a tuber specific promoter is found in U.S. Pat. No. 6,184,443.

Bulb Specific Promoters

An example of a bulb specific promoter is found in Smeets et al., (1997) Plant Physiol. 113:765-771.

Rhizome Preferred Promoters

An example of a rhizome preferred promoter is found Seong Jang et al., (2006) Plant Physiol. 142:1148-1159.

Endosperm Specific Promoters

An example of an endosperm specific promoter is found in U.S. Pat. No. 7,745,697.

Corm Promoters

An example of a promoter capable of driving expression in a corm is found in Schenk et al., (2001) Plant Molecular Biology, 47:399-412.

Photosythetic Tissue Preferred Promoters

Photosythetic tissue preferred promoters include those that are preferentially expressed in photosynthetic tissues of the plants. Photosynthetic tissues of the plant include leaves, stems, shoots and above ground parts of the plant. Photosythetic tissue preferred promoters include light regulated promoters.

Light Regulated Promoters

Numerous light regulated promoters are known to those skilled in the art and include for example chlorophyll a/b (Cab) binding protein promoters and Rubisco Small Subunit (SSU) promoters. An example of a light regulated promoter is found in U.S. Pat. No. 5,750,385. Light regulated in this context means light inducible or light induced.

A "transgene" is a polynucleotide that is taken from one organism and introduced into a different organism by transformation. The transgene may be derived from the same species or from a different species as the species of the organism into which the transgene is introduced.

Host Cells

Host cells may be derived from, for example, bacterial, fungal, yeast, insect, mammalian, algal or plant organisms. Host cells may also be synthetic cells. Preferred host cells are eukaryotic cells. A particularly preferred host cell is a plant cell, particularly a plant cell in a vegetative tissue of a plant.

A "transgenic plant" refers to a plant which contains new genetic material as a result of genetic manipulation or transformation. The new genetic material may be derived from a plant of the same species as the resulting transgenic plant or from a different species.

Methods for Isolating or Producing Polynucleotides

The polynucleotide molecules of the invention can be isolated by using a variety of techniques known to those of ordinary skill in the art. By way of example, such polypeptides can be isolated through use of the polymerase chain reaction (PCR) described in Mullis et al., Eds. 1994 The Polymerase Chain Reaction, Birkhauser, incorporated herein by reference. The polypeptides of the invention can be amplified using primers, as defined herein, derived from the polynucleotide sequences of the invention.

Further methods for isolating polynucleotides of the invention include use of all, or portions of, the polypeptides having the sequence set forth herein as hybridization probes. The technique of hybridizing labelled polynucleotide probes to polynucleotides immobilized on solid supports such as nitrocellulose filters or nylon membranes, can be used to screen the genomic or cDNA libraries. Exemplary hybridization and wash conditions are: hybridization for 20 hours at 65° C. in 5.0×SSC, 0.5% sodium dodecyl sulfate, 1×Denhardt's solution; washing (three washes of twenty minutes each at 55° C.) in 1.0×SSC, 1% (w/v) sodium dodecyl sulfate, and optionally one wash (for twenty minutes) in 0.5×SSC, 1% (w/v) sodium dodecyl sulfate, at 60° C. An optional further wash (for twenty minutes) can be conducted under conditions of 0.1×SSC, 1% (w/v) sodium dodecyl sulfate, at 60° C.

The polynucleotide fragments of the invention may be produced by techniques well-known in the art such as restriction endonuclease digestion, oligonucleotide synthesis and PCR amplification.

A partial polynucleotide sequence may be used, in methods well-known in the art to identify the corresponding full length polynucleotide sequence. Such methods include PCR-based methods, 5'RACE (Frohman M A, 1993, Methods Enzymol. 218: 340-56) and hybridization-based method, computer/database-based methods. Further, by way of example, inverse PCR permits acquisition of unknown sequences, flanking the polynucleotide sequences disclosed herein, starting with primers based on a known region (Triglia et al., 1998, Nucleic Acids Res 16, 8186, incorporated herein by reference). The method uses several restriction enzymes to generate a suitable fragment in the known region of a gene. The fragment is then circularized by intramolecular ligation and used as a PCR template. Divergent primers are designed from the known region. In order to physically assemble full-length clones, standard molecular biology approaches can be utilized (Sambrook et al., Molecular Cloning A Laboratory Manual, 2nd Ed. Cold Spring Harbor Press, 1987).

Variants (including orthologues) may be identified by the methods described.

Methods for Identifying Variants

Physical Methods

Variant polypeptides may be identified using PCR-based methods (Mullis et al., Eds. 1994 The Polymerase Chain Reaction, Birkhauser). Typically, the polynucleotide sequence of a primer, useful to amplify variants of polynucleotide molecules of the invention by PCR, may be based on a sequence encoding a conserved region of the corresponding amino acid sequence.

Alternatively library screening methods, well known to those skilled in the art, may be employed (Sambrook et al., Molecular Cloning: A Laboratory Manual, 2nd Ed. Cold Spring Harbor Press, 1987). When identifying variants of the probe sequence, hybridization and/or wash stringency will typically be reduced relatively to when exact sequence matches are sought.

Polypeptide variants may also be identified by physical methods, for example by screening expression libraries using antibodies raised against polypeptides of the invention (Sambrook et al., Molecular Cloning: A Laboratory Manual, 2nd Ed. Cold Spring Harbor Press, 1987) or by identifying polypeptides from natural sources with the aid of such antibodies.

Computer Based Methods

The variant sequences of the invention, including both polynucleotide and polypeptide variants, may also be identified by computer-based methods well-known to those skilled in the art, using public domain sequence alignment algorithms and sequence similarity search tools to search sequence databases (public domain databases include Genbank, EMBL, Swiss-Prot, PIR and others). See, e.g., Nucleic Acids Res. 29: 1-10 and 11-16, 2001 for examples of online resources. Similarity searches retrieve and align target sequences for comparison with a sequence to be analyzed (i.e., a query sequence). Sequence comparison algorithms use scoring matrices to assign an overall score to each of the alignments.

An exemplary family of programs useful for identifying variants in sequence databases is the BLAST suite of programs (version 2.2.5 [November 2002]) including BLASTN, BLASTP, BLASTX, tBLASTN and tBLASTX, which are publicly available from (ftp://ftp.ncbi.nih.gov/blast/) or from the National Center for Biotechnology Information (NCBI), National Library of Medicine, Building 38A, Room 8N805, Bethesda, Md. 20894 USA. The NCBI server also provides the facility to use the programs to screen a number of publicly available sequence databases. BLASTN compares a nucleotide query sequence against a nucleotide sequence database. BLASTP compares an amino acid query sequence against a protein sequence database. BLASTX compares a nucleotide query sequence translated in all reading frames against a protein sequence database. tBLASTN compares a protein query sequence against a nucleotide sequence database dynamically translated in all reading frames. tBLASTX compares the six-frame translations of a nucleotide query sequence against the six-frame translations of a nucleotide sequence database. The BLAST programs may be used with default parameters or the parameters may be altered as required to refine the screen.

The use of the BLAST family of algorithms, including BLASTN, BLASTP, and BLASTX, is described in the publication of Altschul et al., Nucleic Acids Res. 25: 3389-3402, 1997.

The "hits" to one or more database sequences by a queried sequence produced by BLASTN, BLASTP, BLASTX, tBLASTN, tBLASTX, or a similar algorithm, align and identify similar portions of sequences. The hits are arranged in order of the degree of similarity and the length of sequence overlap. Hits to a database sequence generally represent an overlap over only a fraction of the sequence length of the queried sequence.

The BLASTN, BLASTP, BLASTX, tBLASTN and tBLASTX algorithms also produce "Expect" values for alignments. The Expect value (E) indicates the number of hits one can "expect" to see by chance when searching a database of the same size containing random contiguous sequences. The Expect value is used as a significance threshold for determining whether the hit to a database indicates true similarity. For example, an E value of 0.1 assigned to a polynucleotide hit is interpreted as meaning that in a database of the size of the database screened, one might expect to see 0.1 matches over the aligned portion of the sequence with a similar score simply by chance. For sequences having an E value of 0.01 or less over aligned and matched portions, the probability of finding a match by chance in that database is 1% or less using the BLASTN, BLASTP, BLASTX, tBLASTN or tBLASTX algorithm.

Multiple sequence alignments of a group of related sequences can be carried out with CLUSTALW (Thompson, J. D., Higgins, D. G. and Gibson, T. J. (1994) CLUSTALW: improving the sensitivity of progressive multiple sequence alignment through sequence weighting, positions-specific gap penalties and weight matrix choice. Nucleic Acids Research, 22:4673-4680, www-igbmc<dot>fr/BioInfo/CiustalW/Top<dot>html) or T-COFTEE (Cedric Notredame, Desmond G. Higgins, Jaap Heringa, T-Coffee: A novel method for fast and accurate multiple sequence alignment, J. Mol. Biol. (2000) 302: 205-217)) or PILEUP, which uses progressive, pairwise alignments. (Feng and Doolittle, 1987, J. Mol. Evol. 25, 351).

Pattern recognition software applications are available for finding motifs or signature sequences. For example, MEME (Multiple Em for Motif Elicitation) finds motifs and signature sequences in a set of sequences, and MAST (Motif Alignment and Search Tool) uses these motifs to identify similar or the same motifs in query sequences. The MAST results are provided as a series of alignments with appropriate statistical data and a visual overview of the motifs found. MEME and MAST were developed at the University of California, San Diego.

PROSITE (Bairoch and Bucher, 1994, Nucleic Acids Res. 22, 3583; Hofmann et al, 1999, Nucleic Acids Res. 27, 215) is a method of identifying the functions of uncharacterized proteins translated from genomic or cDNA sequences. The PROSITE database (www<dot>expasy<dot>org/prosite) contains biologically significant patterns and profiles and is designed so that it can be used with appropriate computational tools to assign a new sequence to a known family of proteins or to determine which known domain(s) are present in the sequence (Falquet: et al, 2002, Nucleic Acids Res, 30, 235). Pros catch is a tool that can search SWISS-PROT and EMBL databases with a given sequence, pattern or signature.

Methods for Isolating Polypeptides

The polypeptides used in the methods of the invention, including variant polypeptides, may be prepared using peptide synthesis methods well known in the art such as direct peptide synthesis using solid phase techniques (e.g. Stewart et al., 1969, in Solid-Phase Peptide Synthesis, WH Freeman Co, San Francisco Calif., or automated synthesis, for example using an Applied Biosystems 431A Peptide Synthesizer (Foster City, Calif.). Mutated forms of the polypeptides may also be produced during such syntheses.

The polypeptides and variant polypeptides used in the methods of the invention, may also be purified from natural sources using a variety of techniques that are well known in the art (e.g. Deutscher, 1990, Ed, Methods in Enzymology, Vol. 182, Guide to Protein Purification).

Alternatively the polypeptides and variant polypeptides used in the methods of the invention, may be expressed recombinantly in suitable host cells and separated from the cells as discussed below.

Methods for Producing Constructs and Vectors

The genetic constructs expressing the encapsulated proteins according to the invention may be useful for transforming, for example, bacterial, fungal, insect, mammalian or plant organisms. The genetic constructs of the invention are intended to include expression constructs as herein defined.

Methods for producing and using genetic constructs and vectors are well known in the art and are described generally in Sambrook et al., Molecular Cloning: A Laboratory Manual, 2nd Ed. Cold Spring Harbor Press, 1987; Ausubel et al., Current Protocols in Molecular Biology, Greene Publishing, 1987).

Polynucleotides, expression cassettes, and constructs can also be conveniently synthesized in their entirety using techniques well-known and or available to those skilled in the art Methods for Producing Host Cells Comprising Polynucleotides Constructs or Vectors Host cells comprising genetic constructs, such as expression constructs, of the invention are useful in methods well known in the art (e.g. Sambrook et al., Molecular Cloning: A Laboratory Manual, 2nd Ed. Cold Spring Harbor Press, 1987; Ausubel et al., Current Protocols in Molecular Biology, Greene Publishing, 1987) for recombinant production of encapsulated proteins. Such methods may involve the culture of host cells in an appropriate medium in conditions suitable for or conducive to expression of a polypeptide of the invention. The expressed recombinant polypeptide, which may optionally be secreted into the culture, may then be separated from the medium, host cells or culture medium by methods well known in the art (e.g. Deutscher, Ed, 1990, Methods in Enzymology, Vol 182, Guide to Protein Purification).

Methods for Producing Plant Cells and Plants Comprising Constructs and Vectors

The invention further provides methods for producing plant cells and plants expressing the encapsulated proteins.

Methods for transforming plant cells, plants and portions thereof with polypeptides are described in Draper et al., 1988, Plant Genetic Transformation and Gene Expression. A Laboratory Manual. Blackwell Sci. Pub. Oxford, p. 365; Potrykus and Spangenburg, 1995, Gene Transfer to Plants. Springer-Verlag, Berlin; and Gelvin et al., 1993, Plant Molecular Biol. Manual. Kluwer Acad. Pub. Dordrecht. A review of transgenic plants, including transformation techniques, is provided in Galun and Breiman, 1997, Transgenic Plants. Imperial College Press, London.

Methods for Genetic Manipulation of Plants

A number of plant transformation strategies are available (e.g. Birch, 1997, Ann Rev Plant Phys Plant Mol Biol, 48, 297; Hellens et al., 2000, Plant Mol Biol 42: 819-32; Hellens et al., Plant Meth 1: 13). For example, strategies may be designed to increase expression of a polynucleotide/polypeptide in a plant cell, organ and/or at a particular developmental stage where/when it is normally expressed or to ectopically express a polynucleotide/polypeptide in a cell, tissue, organ and/or at a particular developmental stage which/when it is not normally expressed. The expressed polynucleotide/polypeptide may be derived from the plant species to be transformed or may be derived from a different plant species.

Genetic constructs for expression of genes in transgenic plants typically include promoters for driving the expression of one or more cloned polynucleotide, terminators and selectable marker sequences to detect presence of the genetic construct in the transformed plant.

The promoters suitable for use in the constructs of this invention are functional in a cell, tissue or organ of a monocot or dicot plant and include cell-, tissue- and organ-specific promoters, cell cycle specific promoters, temporal promoters, inducible promoters, constitutive promoters that are active in most plant tissues, and recombinant promoters. Choice of promoter will depend upon the temporal and spatial expression of the cloned polynucleotide, so desired. The promoters may be those normally associated with a transgene of interest, or promoters which are derived from genes of other plants, viruses, and plant pathogenic bacteria and fungi. Those skilled in the art will, without undue experimentation, be able to select promoters that are suitable for use in modifying and modulating plant traits using genetic constructs comprising the polynucleotide sequences of the invention. Examples of constitutive plant promoters include the CaMV 35S promoter, the nopaline synthase promoter and the octopine synthase promoter, and the Ubi 1 promoter from maize. Plant promoters which are active in specific tissues respond to internal developmental signals or external abiotic or biotic stresses are described in the scientific literature. Exemplary promoters are described, e.g., in WO 02/00894 and WO2011/053169, which is herein incorporated by reference.

Exemplary terminators that are commonly used in plant transformation genetic construct include, e.g., the cauliflower mosaic virus (CaMV) 35S terminator, the *Agrobacterium tumefaciens* nopaline synthase or octopine synthase terminators, the *Zea mays* zein gene terminator, the *Oryza sativa* ADP-glucose pyrophosphorylase terminator and the *Solanum tuberosum* PI-II terminator.

Selectable markers commonly used in plant transformation include the neomycin phosphotransferase II gene (NPT II) which confers kanamycin resistance, the aadA gene, which confers spectinomycin and streptomycin resistance, the phosphinothricin acetyl transferase (bar gene) for Ignite (AgrEvo) and Basta (Hoechst) resistance, and the hygromycin phosphotransferase gene (hpt) for hygromycin resistance.

The following are representative publications disclosing genetic transformation protocols that can be used to genetically transform the following plant species: Rice (Alam et al., 1999, Plant Cell Rep. 18, 572); apple (Yao et al., 1995, Plant Cell Reports 14, 407-412); maize (U.S. Pat. Nos. 5,177,010 and 5,981,840); wheat (Ortiz et al., 1996, Plant Cell Rep. 15, 1996, 877); tomato (U.S. Pat. No. 5,159,135); potato (Kumar et al., 1996 Plant J. 9, 821); cassava (Li et al., 1996 Nat. Biotechnology 14, 736); lettuce (Michelmore et al., 1987, Plant Cell Rep. 6, 439); tobacco (Horsch et al., 1985, Science 227, 1229); cotton (U.S. Pat. Nos. 5,846,797 and 5,004,863); grasses (U.S. Pat. Nos. 5,187,073 and 6,020,539); peppermint (Niu et al., 1998, Plant Cell Rep. 17, 165); citrus plants (Pena et al., 1995, Plant Sci. 104, 183); caraway (Krens et al., 1997, Plant Cell Rep, 17, 39); banana (U.S. Pat. No. 5,792,935); soybean (U.S. Pat. Nos. 5,416, 011; 5,569,834; 5,824,877; 5,563,04455 and 5,968,830); pineapple (U.S. Pat. No. 5,952,543); poplar (U.S. Pat. No. 4,795,855); monocots in general (U.S. Pat. Nos. 5,591,616 and 6,037,522); brassica (U.S. Pat. Nos. 5,188,958; 5,463, 174 and 5,750,871); cereals (U.S. Pat. No. 6,074,877); pear (Matsuda et al., 2005, Plant Cell Rep. 24(1):45-51); *Prunus* (Ramesh et al., 2006 Plant Cell Rep. 25(8):821-8; Song and Sink 2005 Plant Cell Rep. 2006; 25(2):117-23; Gonzalez Padilla et al., 2003 Plant Cell Rep. 22(1):38-45); strawberry (Oosumi et al., 2006 Planta. 223(6):1219-30; Folta et al., 2006 Planta April 14; PMID: 16614818), rose (Li et al., 2003), *Rubus* (Graham et al., 1995 Methods Mol Biol. 1995; 44:129-33), tomato (Dan et al., 2006, Plant Cell Reports V25:432-441), apple (Yao et al., 1995, *Plant Cell Rep.* 14, 407-412), Canola (*Brassica napus* L.). (Cardoza and Stewart, 2006 Methods Mol Biol. 343:257-66), safflower (Orlikowska et al, 1995, Plant Cell Tissue and Organ Culture 40:85-91), ryegrass (Altpeter et al., 2004 Developments in Plant Breeding 11 (7):255-250), rice (Christou et al., 1991 Nature Biotech. 9:957-962), maize (Wang et al., 2009 In: Handbook of Maize pp. 609-639) and *Actinidia eriantha* (Wang et al., 2006, Plant Cell Rep. 25, 5: 425-31). Transformation of other species is also contemplated by the invention. Suitable methods and protocols are available in the scientific literature.

BRIEF DESCRIPTION OF THE DRAWINGS

Figure 12:
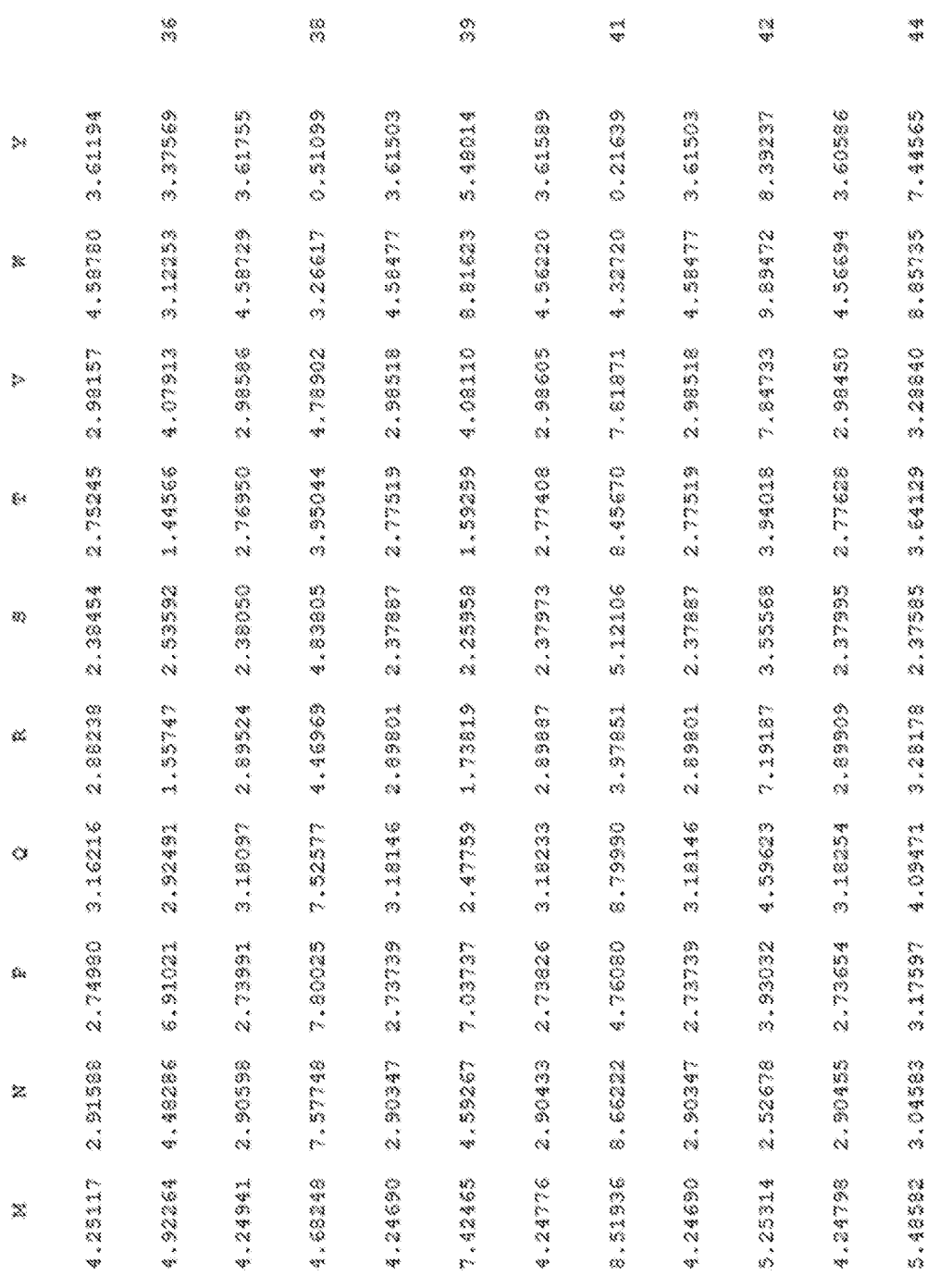

FIG. 12. Profile-HMM that describes the RHS repeat, as defined in the Pfam database (pfam<dot>sanger<dot>ac<dot>uk; /family/PF05593).

Figure 13:
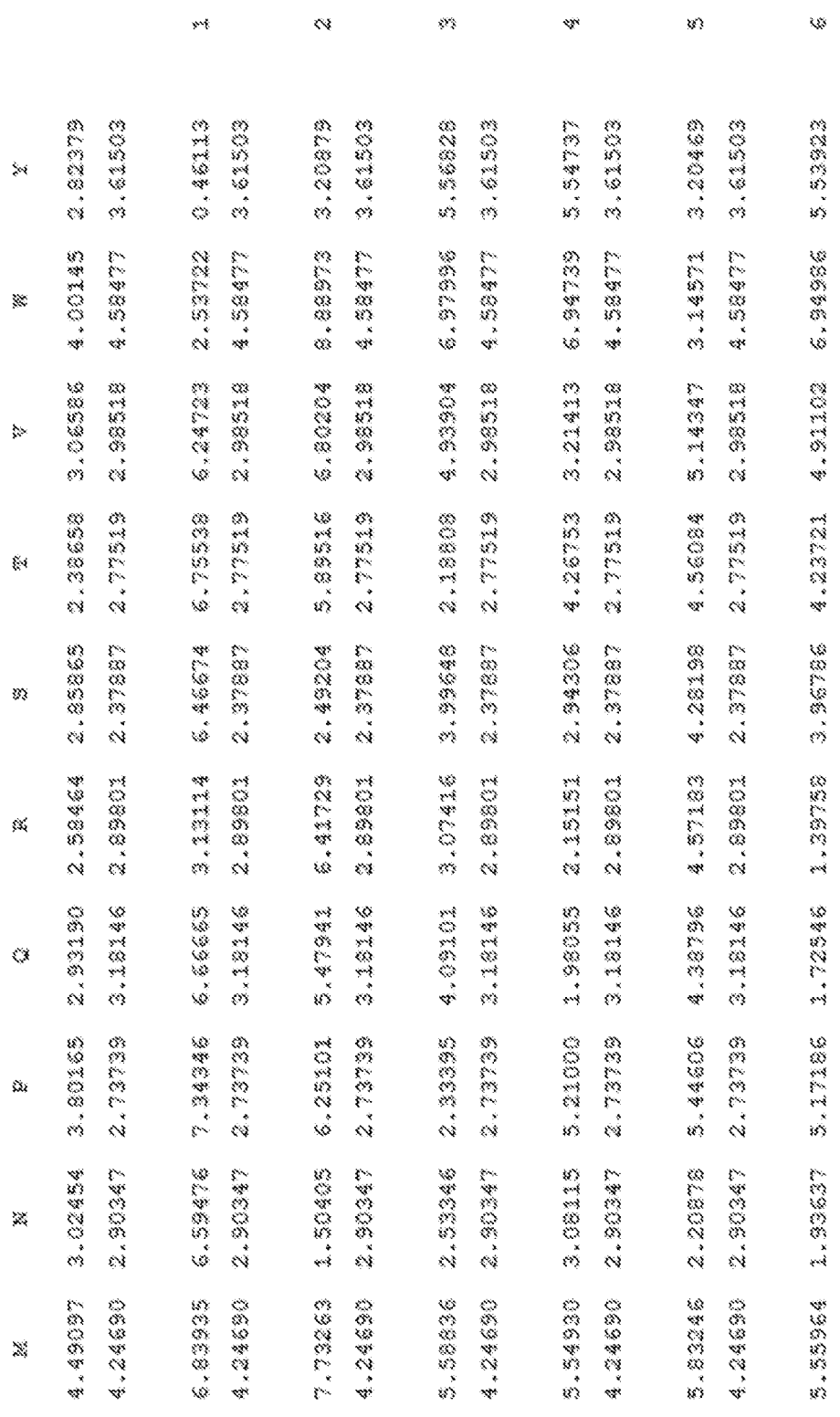

FIG. 13. Profile-HMM that describes the YD repeat, as defined in the TIGRfams database (www<dot>jcvi<dot>org/cgi-bin/tigrfams/HmmReportPage. cgi?acc=TIG R01643)

FIG. 14. Composite profile-HMM that describes both the RHIS repeat and the YD repeat, constructed using the program jackhmmer (hmmer<dot>janelia<dot>org/search/jackhmmer).

Figure 15:
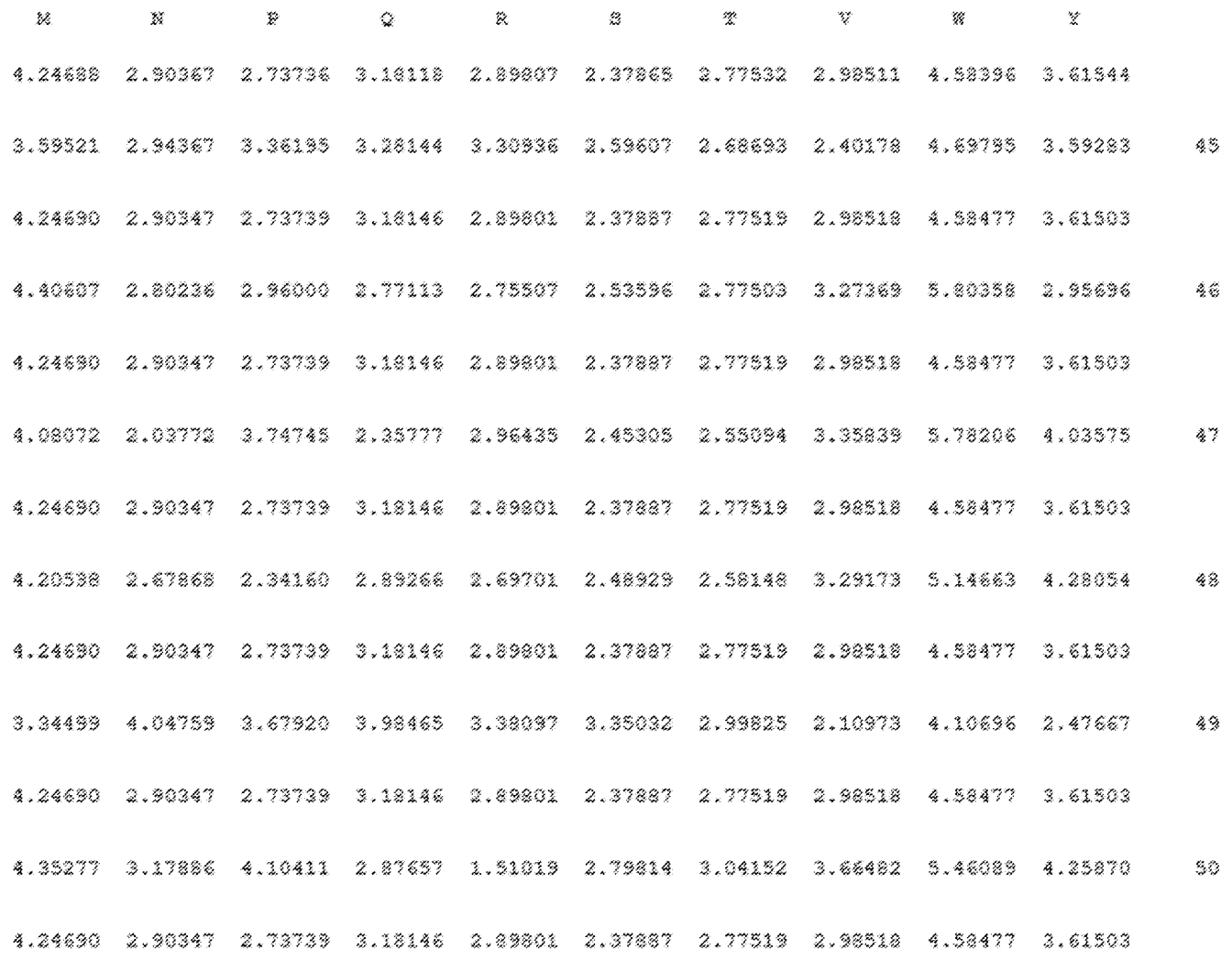

FIG. 15. Profile-HMM that describes the RHS repeat-associated core domain, as defined in the TIGRfams database (www<dot>jcvi<dot>org/cgi-bin/tigrfams/HmmReportPage<dot>cgi?acc=T1G R03696).

EXAMPLES

The invention will now be exemplified with reference to the following non-limiting Examples Example 1: Elucidation of the Structure of the Complex Formed Between the TcB and TcC Components of ABC Toxin Complexes (Tc)

Figure 1:
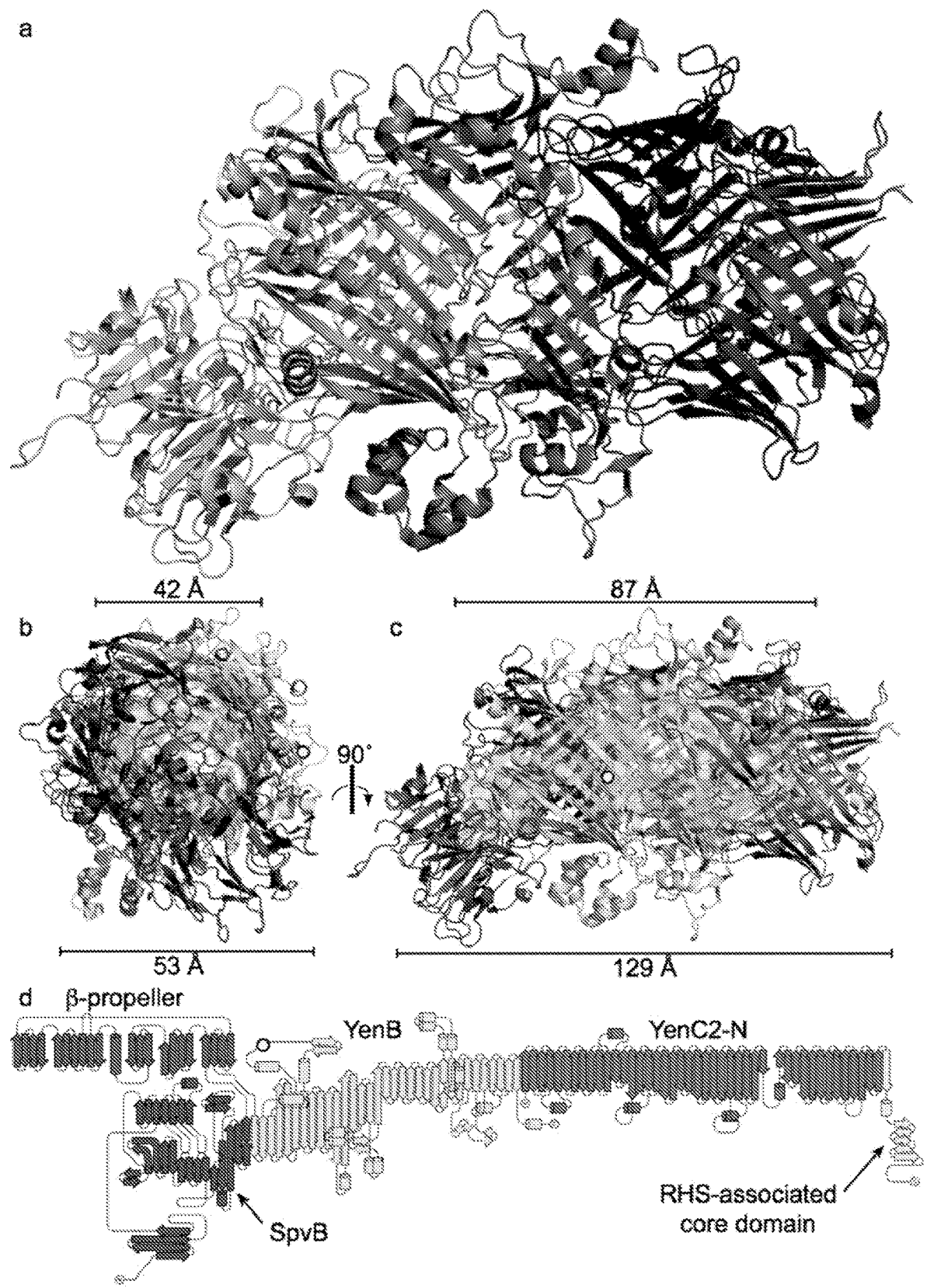
FIG. 1 shows the structure of the YenB/YenC2-N complex. a, Ribbon diagram of YenB/YenC2-N. YenB is on the left in light grey and YenC is on the right in dark grey. b-c, Orthoganol views of the complex, with the central cavity shown as a translucent surface and the protein as grey ribbons, and with approximate interior and exterior diameters marked. The position of an RGD motif is shown with a circle. d, a schematic topology diagram of the structure with α-helices shown as cylinders and β-sheets as arrows, and the domains labelled.
Figure 2:
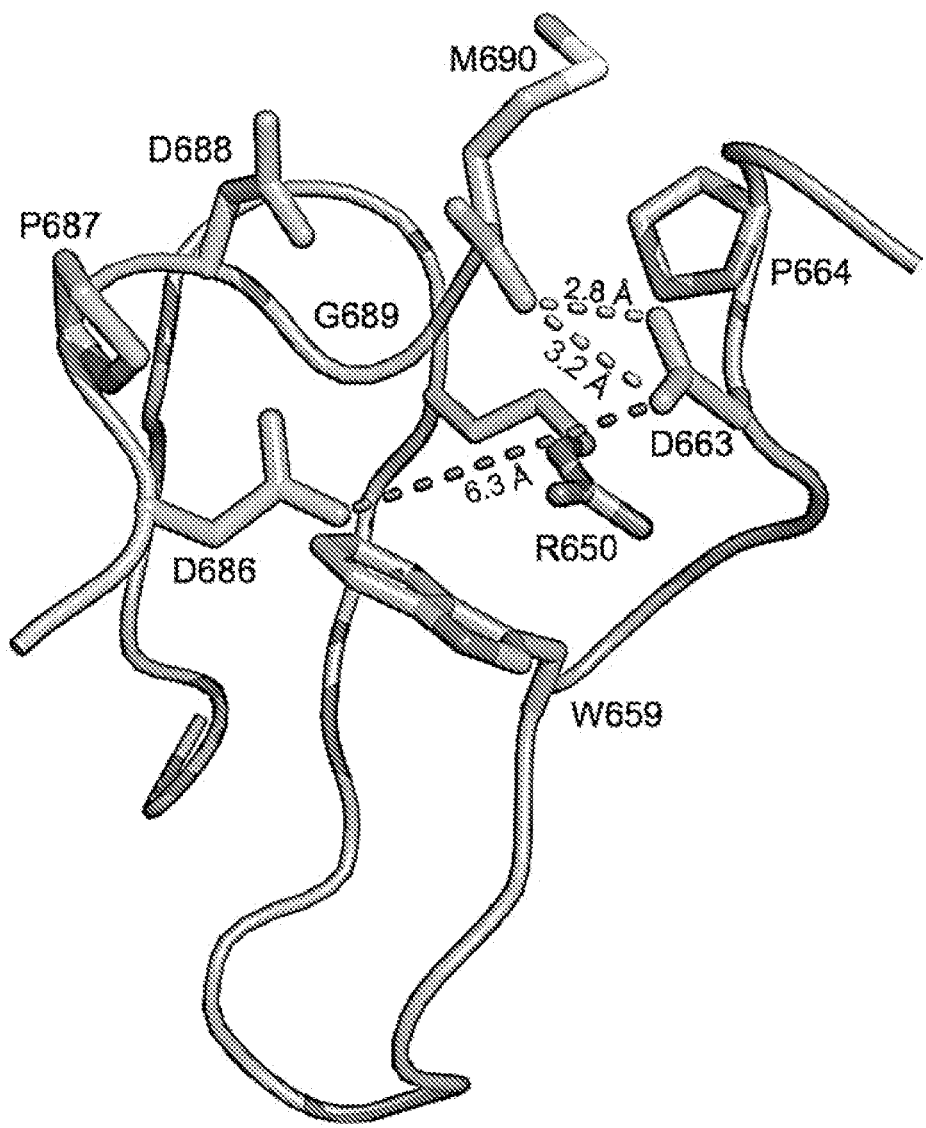
FIG. 2 shows structural details of the YenC2-N auto-proteolysis site. The site of auto-proteolysis in YenC. The residues immediately upstream of the cleavage point are D686, P687, D688, G689 and M690. The side chains of a selection of residues conserved in the RHS-associated core domain are shown. The distance (6.3 Å) between the two conserved residues that are essential for proteolysis, D686 and D663, is shown in dark grey. The side chain of D663 is within hydrogen-bonding distance of the terminal carboxyl group of the cleaved peptide (distances (2.8 Å and 3.2 Å) shown in light grey).
Figure 3:
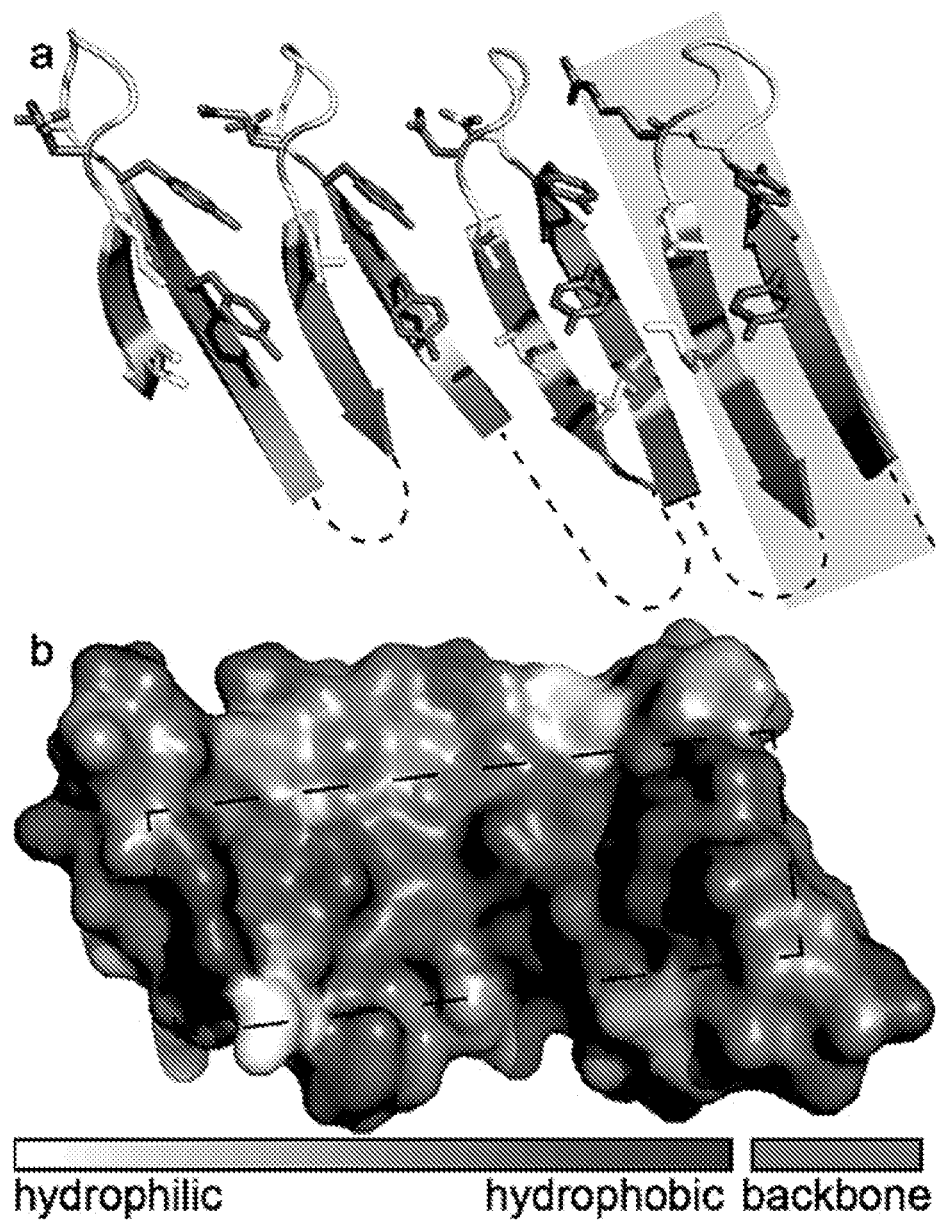
FIG. 3 shows RHS repeat structure. a, A section of the shell showing the pattern of RHS repeats, viewed from the inside of the central cavity. A single RHS repeat is highlighted with a grey background box. The ordered loop made by the DxxG motif is shown at the top and the conserved pattern of hydrophobic residues on the face of the β-sheet is shown in dark grey (conserved tyrosines) and light grey (other hydrophobic residues). b, The same face of the β-sheet shown as a solvent accessible surface and coloured by side-chain hydrophobicity (hydrophilic as white, hydrophobic as dark grey, protein backbone as mid grey). The stripe formed by the conserved hydrophobic residues is boxed with a dashed line.

The ABC toxin complexes (Tc) produced by some bacteria are of interest due to their potent oral insecticidal activity[1,2] and potential role in human disease[3]. They are composed of at least three proteins, TcA, TcB and TcC, which must assemble together in order to be fully toxic[4]. The carboxy-terminal section of TcC is the main cytotoxic component[5], and displays remarkable heterogeneity between different Tcs. A general model of action has been proposed, in which the TcA component first binds to the cell surface, is endocytosed and subsequently forms a pH-triggered channel, allowing the translocation of TcC into the cytoplasm[5], where it can cause cytoskeletal disruption in both insect and mammalian cells. Tc complexes have been visualised using single particle electron microscopy[6,7], but no high-resolution structures of the components are available, and the role of TcB in the mechanism of toxicity remains unknown. Here we report the three-dimensional structure of the complex between TcB and the conserved amino-terminal section of TcC determined to 2.3 Å by X-ray crystallography. These components assemble to form an unprecedented large hollow structure that encapsulates and sequesters the cytotoxic carboxy-terminal portion of TcC like the shell of an egg. The shell is decorated on one end with β-propeller domain, which mediates attachment of the TcB/TcC dimer to the TcA component of the complex. Furthermore, the structure shows how TcC auto-proteolyses when folded in complex with TcB. TcC is the first known protein structure to contain RHS (rearrangement hot spot) repeats[8], and illustrates the structural architecture that is likely to be conserved across this widely distributed bacterial protein family and the related eukaryotic YD-repeat-containing protein family, which includes the teneurins[9]. In addition to indicating the function of these protein families, the structure suggests a generic mechanism for protein encapsulation and delivery.

ABC toxins were first identified, and have been best characterised, in the bacterium *Photorhabdus luminescens*. The entomopathogenic bacterium *Yersinia entomophaga* contains a related Tc locus where the TcA component is split into two ORFs (YenA1 and Yen A2), along with a single TcB gene (YenB) and two TcC genes (YenC1 and YenC2)[10]. The TcC proteins of this and other Tcs are similar to the "polymorphic toxins" described by Zhang et al.[11] as they have a conserved RHS-repeat-containing amino-terminal region and a variable carboxy-terminal region[10]. The carboxy-terminal regions of the *Y. entomophaga* TcC proteins are predicted to have different toxic activities: YenC1-C is homologous to cytotoxic necrotising factor 1 (CNF1) from *Escherichia coli*[12], while YenC2-C is homologous to the deaminase YwqJ from *Bacillus subtilis*[13]. When YenB and YenC1 or YenC2 proteins are co-expressed, the YenC proteins are cleaved at the boundary between the conserved amino-terminal domain and the variable carboxy-terminal domain.

As the function of TcB proteins in Tcs is unknown, we prepared the complex of YenB (167 kDa) with the conserved N-terminal 76 kDa portion of YenC2 (YenC2-N) by co-expression and incubation at low pH (Supplementary methods), and solved its structure using X-ray crystallography (Table S1). The structure reveals a remarkable, intimately associated heterodimer formed by YenB and YenC2-N that cooperatively fold into a large, hollow shell (FIG. 1*a*). An immediately striking feature is the single long β-sheet, comprised of 76 β-strands derived from both proteins, that constitutes the majority of the shell structure. The shell is completed by a second β-sheet formed by 14 strands contributed by YenC2-N, bringing to 90 the total number of β-strands that wrap around what is a substantial central cavity (FIG. 1 *b* & *c*; FIG. 5). The carboxy-terminus of YenB is in close proximity to the amino-terminus of YenC2, suggesting that the two proteins could be produced as a single polypeptide. Evidence in support of this can be found in the bacterium *Burkholderia rhizoxinica* where a single ORF (tcdB2) encodes an apparent TcB-TcC fusion protein.

The central cavity is a solvent-accessible space approximately 42 Å wide and 87 Å long, with a total enclosed volume of approximately 59,000 $Å^3$. The shell is closed at both ends—the YenB end by a β-propeller domain inserted into the loop between strands β29 and β51, and the YenC2 end by another short strip of β-sheet (strands 145-149) that spirals inwards, forming a plug. The overall shape is reminiscent of a hollow egg.

The carboxy-terminal end of YenC2-N (i.e. the cleavage site between the two portions of YenC2) lies inside this shell. We therefore propose that the complete YenB/YenC complex encapsulates YenC2-C within the shell of β-sheets created by YenB and YenC2-N. This proposal is supported by small-angle X-ray scattering data, which are consistent with a hollow spheroid for the YenB/YenC2-N complex, but with a solid spheroid for the complete YenB/YenC2 complex (Supplementary FIGS. 2-4 and Tables 8-11). This explains how YenC2-C remains tightly associated with the complex after auto-proteolysis, in the absence of any covalent linkage between the proteins. In broader terms, this also explains how generally cytotoxic proteins encoded by the C-terminal regions of TcC proteins, such as deaminases, can be safely produced without intoxication of the producing cell. According to the current model, the toxic payload, in this case YenC2-C, remains sequestered until exposure to a change in pH triggers its release[5].

The amino acids immediately before the YenC2 cleavage site are clearly visible in the electron density, allowing us to suggest a mechanism of auto-proteolysis. We propose that two aspartate residues (D663 and D686) positioned either side of the last residue prior to cleavage (M690), form the catalytic site for proteolysis (FIG. 2). In our structure, they are too far apart to form the canonical aspartic protease arrangement (6.2 Å between carboxyl oxygens), but as we have visualised the post-cleavage state, it is possible that prior to cleavage these residues may adopt a slightly different conformation. To establish their role, we made point mutations that replaced the conserved aspartates with asparagines (D663N & D686N), and showed that mutation of either residue completely abolished auto-proteolytic activity (FIG. 9). These residues are part of the strongly conserved RHS repeat-associated core domain[14] (TIGRfam TIGR03696, Interpro IPR022385), which is widely distributed across the archaea, bacteria and eukaryota. Our structure therefore shows this domain to be a cryptic aspartic protease.

RHS repeats themselves are present in many polymorphic toxin complexes that are found across a diverse range of bacterial species. Until now, RHS-repeat containing proteins have been structurally intractable, making this structure of YenC-N the first of any protein containing RHS repeats. Individual RHS repeat proteins can vary in size, and the overall sequence conservation across the family is low, but a consensus sequence for the repeat has been previously defined: GxxxRYxYDxxGRL(I/T)[15]. When this is mapped onto the structure of YenC-N (FIG. 3), it is clear that each RHS repeat corresponds to a single strand-turn-strand motif, multiple copies of which make up the extended β-sheet of the shell. Although the initial glycine is not especially well conserved, it marks the hairpin facing the YenC2-end of the shell. The central DxxG creates the hairpin facing the YenB-end, with the aspartic acid hydrogen-bonding to the backbone amides of the glycine and adjacent arginine. This glycine is largely conserved, but the aspartic acid can be replaced by a glutamic acid, threonine or serine and typically the interactions formed remain the same. The YxY motif places the two tyrosine sidechains inside the shell (coloured magenta in FIG. 3a) where they sit parallel to each other, and also stack with the post-hairpin arginine from an adjacent strand. The conserved hydrophobic amino acids at the C-terminal end of the repeat (coloured yellow in FIG. 3a) also lie inside the shell, forming a continuous hydrophobic stripe along the face of the β-sheet composed of tyrosines and leucines/isoleucines on alternating strands (FIG. 3b).

The RHS structural motif is present in YenB as well as YenC2-N, albeit with less sequence conservation. The YenB sequence contains more insertions and extensions within the RHS repeats than the YenC sequence, which makes identifying the RHS pattern difficult by sequence conservation alone. However, inspection of the structure reveals many examples of DxxG turns and tyrosine or phenylalanine sidechains arranged in an equivalent fashion. Using this structural conservation as a guide, we were able to produce a refined consensus sequence for the RHS repeat (FIG. 10) and show that the pattern of conservation is identical to that seen in YD repeats (TIGRfam TIGR01643; FIGS. 10, 12, 13, 14) that are found in many bacterial and eukaryotic proteins, notably in the extracellular domains of teneurins, which are developmental signalling proteins conserved from flies to mammals and required for synaptic partner matching[16,17]. We propose that RHS and YD repeats represent a conserved structural motif that will always give rise to an extended β-sheet, forming a shell structure similar to that seen here. Support for this proposal can be found in previous low-resolution EM images of the extracellular domains of mouse teneurin, which revealed globular domain of similar dimensions to the YenB/YenTc-C complex[18]. We predict that the YD-repeat containing domains of eukaryotic teneurins will encapsulate their C-terminal regions, the teneurin C-terminal associated peptides (TCAPs), which are known to be active extracellular signalling components in mice[19,20].

Figure 4:
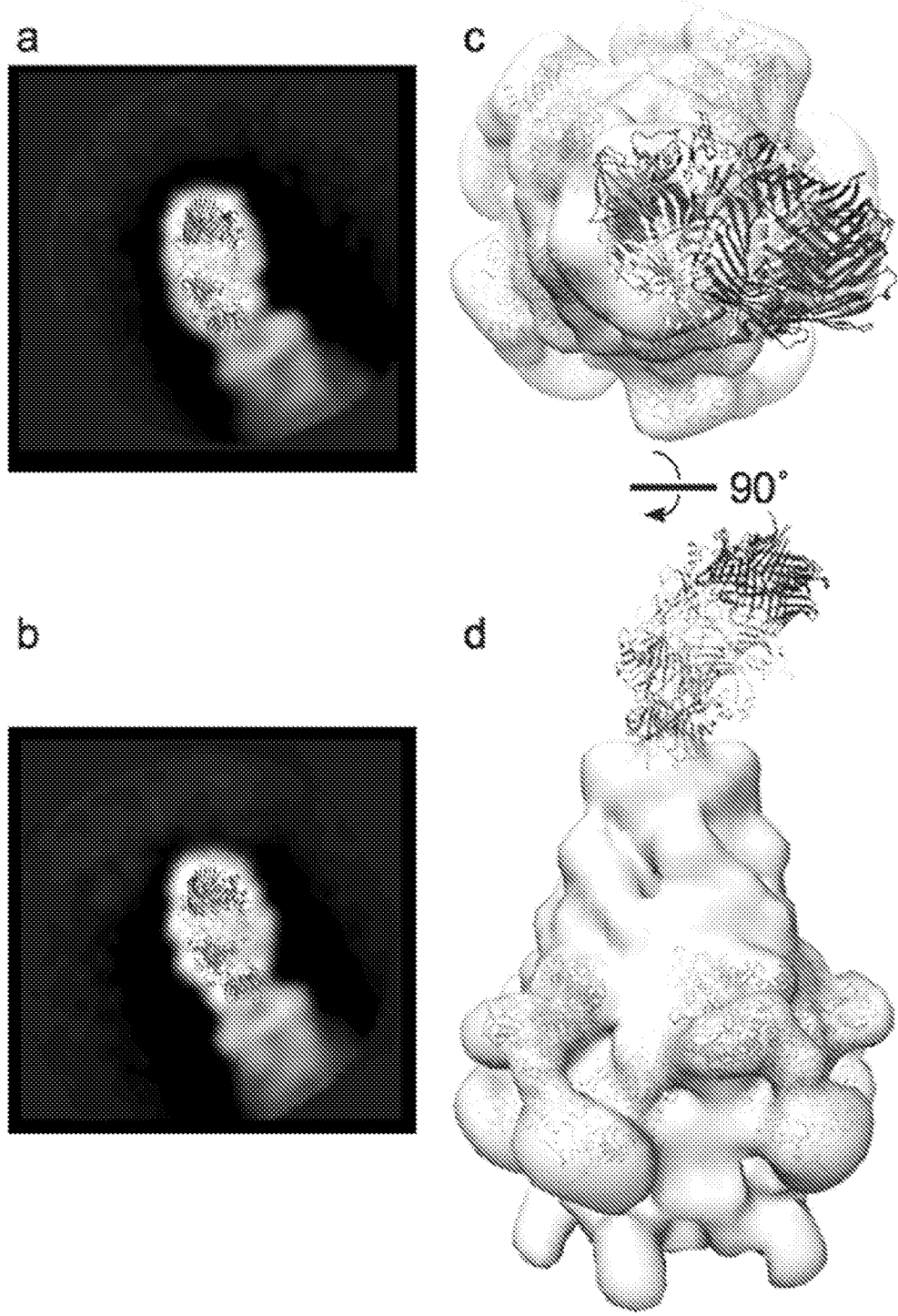
FIG. 4 shows the position of the YenB/YenC2-N complex in the complete Yen-Tc particle. a-b, The YenB/YenC2-N dimer is shown as a ribbon diagram, fitted to fitted to EM class averages of the complete Yen-Tc toxin particle. c-d, Orthogonal views of the complete Yen-Tc complex. The YenB/YenC2-N dimer is shown as a ribbon diagram. The associated chitinases Chi1[35] and Chi2 (PDB ID: 4DWS) are shown as pale grey ribbon diagrams. The EM map of the YenA/Chi1/Chi2 complex determined at a resolution of 17 Å by single particle averaging[6] is shown as a light grey surface.
Figure 5:
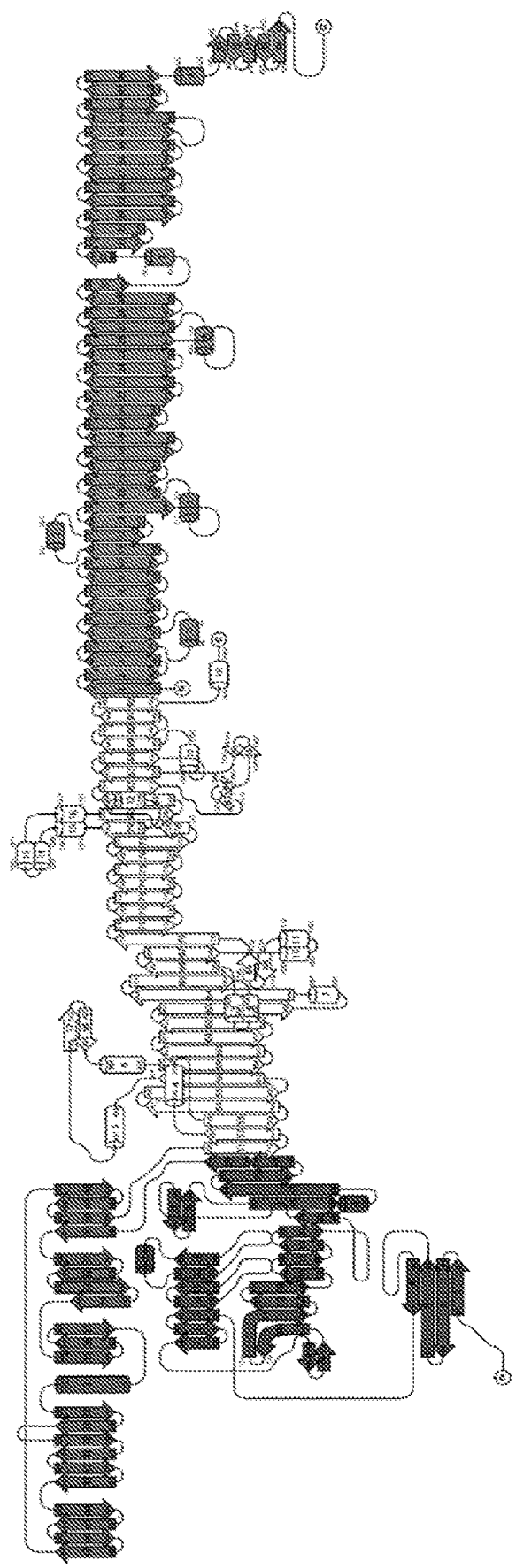
FIG. 5 shows a topology diagram of YenB/YenC2-N. The YenB/YenC2-N structure is shown in schematic form with α-helices as cylinders and β-sheets as arrows. The start and end points of secondary structure elements are indicated. The domains are composed as follows: β-strands 1-29, YenB SpvB domain; β-strands 30-50, YenB β-propeller domain; β-strands 51-92 (light grey), the remainder of YenB; β-strands 1-44 (dark grey), YenC2-N; β-strands 45-49 (dark grey), YenC2-N RHS hyper-conserved core domain.

Previous visualisations of complete ABC Tcs from *Y. entomaphaga*[6] and *P. luminescens*[7] have shown that the TcB/TcC complex sits in the vestibule of the channel-forming domain of TcA, positioned at the end of the Tc complex furthest from the membrane. Fitting the YenB/YenC-N structure into the 25 Å EM map of the *P. luminescens* Tc unambiguously places the five-bladed β-propeller domain of the TcB/TcC as a point of interaction with the TcA pentamer (FIG. 4). In Tcs such as Yen-Tc, where the TcA component is encoded by two separate ORFs, this represents an interaction with YenA2. We are now able to model the complete Yen-Tc complex for the first time (FIG. 4) by docking both the YenB/YenC-N complex and both associated chitinase enzymes, Chi1 and Chi2, onto the previously determined 16 Å EM structure of the *Y. entomaphaga* YenA pentamer[6].

Figure 11:
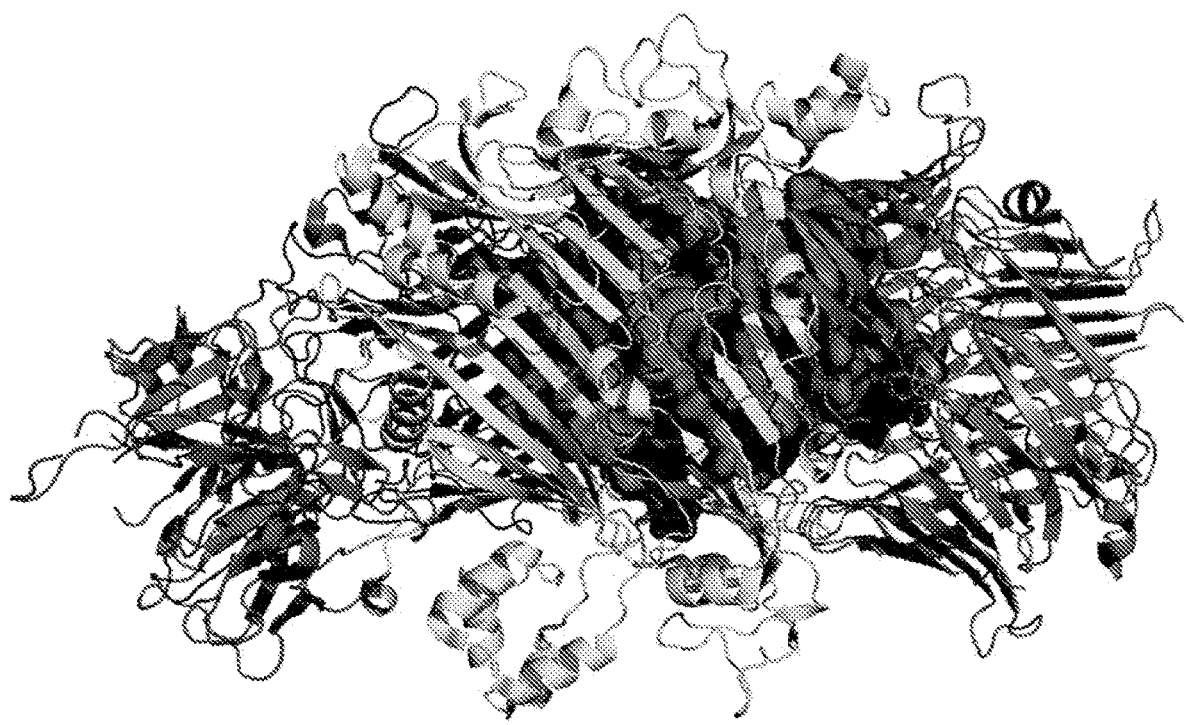
FIG. 11 shows the E. coli CNF1 catalytic domain compared with YenB/YenC2-N. The catalytic domain of E. coli CNF1 (dark grey surface representation), which is homologous to YenC1-C, is shown manually placed inside the hollow shell formed by YenB/YenC2-N (cartoon diagram). This shows that the central cavity of YenB/YenC2-N is large enough to accommodate the C-terminal toxin domain of the YenC proteins.

A general model for the injection mechanism of Tcs has been proposed, based on the EM structure of a membrane-bound form of the *P. luminescens* Tc, in which the C-terminal domain of TcC is translocated in an unfolded state through a transmembrane pore, 15 Å in diameter, formed by TcA. It remains unclear whether the toxic C-terminal region of YenC is encapsulated in a folded or unfolded state within the YenB/YenC-N shell, but the central cavity is large enough to contain the C-terminal region of YenC2 in a folded state, assuming it adopts the same fold as other deaminases (FIG. 11). As the pore of the TcA channel has not yet been visualised in an active conformation, it remains a possibility that the translocation state of the toxin contains an open pore wide enough to allow the passage of a folded protein. On the other hand, the overall architecture of the YenB/YenC-N shell, with its conserved RHS repeats producing an interior hydrophobic pattern of tyrosine, leucine and isoleucine residues, is reminiscent of the protein chaperone GroEL[21], perhaps implying that the function of TcB/TcC proteins, and of RHS and YD repeats more generally, is to encapsulate unfolded proteins. There is support for this idea in the observation that many polymorphic toxins have predicted proteases as their toxic components, which would need to be contained in an inactive state to prevent proteolysis of the shell itself.

Release of the encapsulated TcC-C from the TcB/TcC-N shell will require a conformational change, as there are no gaps in the structure large enough for a polypeptide to pass though. Two possibilities exist the β-propeller blades could separate, allowing extrusion of an unfolded polypeptide through the middle of the propeller, or the propeller domain could swing aside like a bottle-top, hinged on the β29/β30 and β50/β51 loops, which form the only covalent connections between the β-propeller and the main body of the shell. Either mechanism is likely to be dependent on both a pH-driven tigger and mechanical interactions with the TcA component of the toxin.

The structure of the YenB/YenC-N complex presented here reveals how the cytotoxic TcC components of ABC-type Tc complexes are processed and contained, demonstrates the function of the TcB component within the Tc and provides a framework for further experiments to build a complete mechanistic model of action for this class of toxins. More broadly, it also illuminates the function of the widely distributed RHS and YD repeat families of proteins, which had until now been unknown.

Methods Summary

The YenB/YenC2 protein complex was produced by co-expression in *E. coli* and purified using Ni-affinity and size exclusion chromatography. The YenB/YenC2-N protein complex was obtained by dialysing YenB/YenC2 against acetate buffer at pH 4.5, filtration and size exclusion chromatography. Crystallisation was carried out by hanging-drop vapor diffusion with microseeding in drops containing 18% (w/v) PEG 3350, 0.15 M $KH_2PO_4$ pH 4.8. X-ray diffraction data was collected to a resolution of 2.26 Å at beamline MX2 at the Australian Synchrotron[22], integrated using XDS[23] and scaled and merged using Aimless[24] (Tables 6 and 7). Phasing was accomplished by a combination of MAD and SAD using $Ta_6Br_{12}$ soaked and selenomethionine-substituted crystals[25,26]. Structure refinement and analysis was performed using Phenix[27] and diagrams were produced using PyMol[28] and Chimera[29]

Supplementary Methods.

YenC-C Dissociates at Low pH

When YenB and either YenC1 or YenC2 were co-expressed in *E. coli*, YenC1 and YenC2 auto-proteolysed into two fragments as described previously (ref). In both cases, although all three protein fragments co-eluted as a single complex when purified by size-exclusion chromatography, we were unable to crystallise the purified complexes. As the current model for Tc cell entry involves exposure to low pH in the acidified endosome[5], we tested the behaviour of YenB+YenC1/YenC2 complexes at a range of pH conditions from 4.5 to 9.5. At low pH (4.5-5.0), the complexes began to precipitate, with the C-terminal domains of the YenC proteins showing differential precipitation, allowing purification of complexes containing just YenB and the N-terminal portions of YenC.

SAXS Data Collection and Processing

Figure 6:
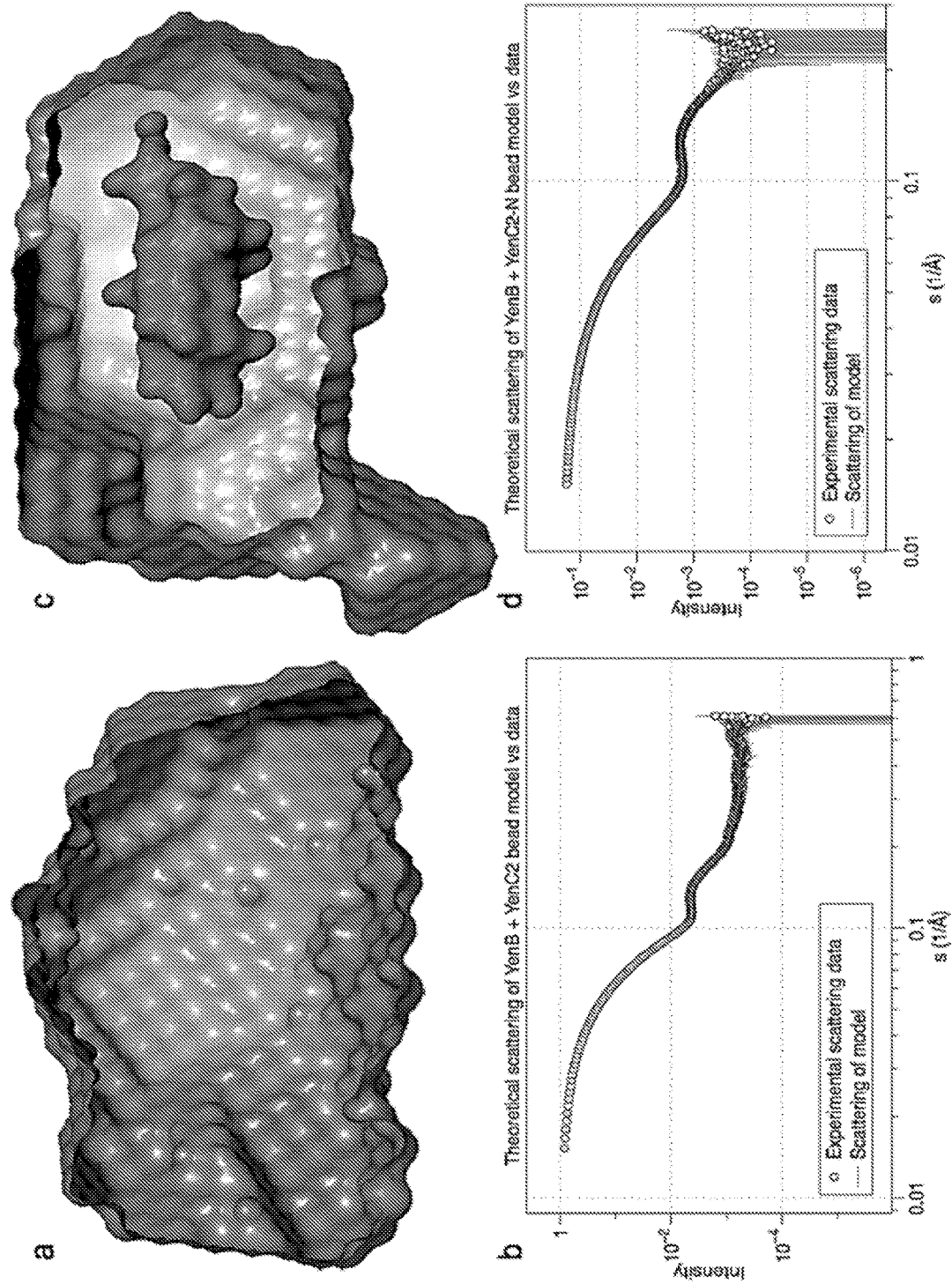
FIG. 6 shows SAXS bead models of YenB/YenC2 and YenB/YenC2-N. a and c, a slice through the ab initio bead models produced from small-angle X-ray scattering of YenB/YenC2 and YenB/YenC2-N respectively. The model of YenB/YenC2-N has a large internal cavity shown in dark grey, absent from the model of YenB/YenC2. b and d, fit of the ab initio bead models to scattering data.
Figure 7:
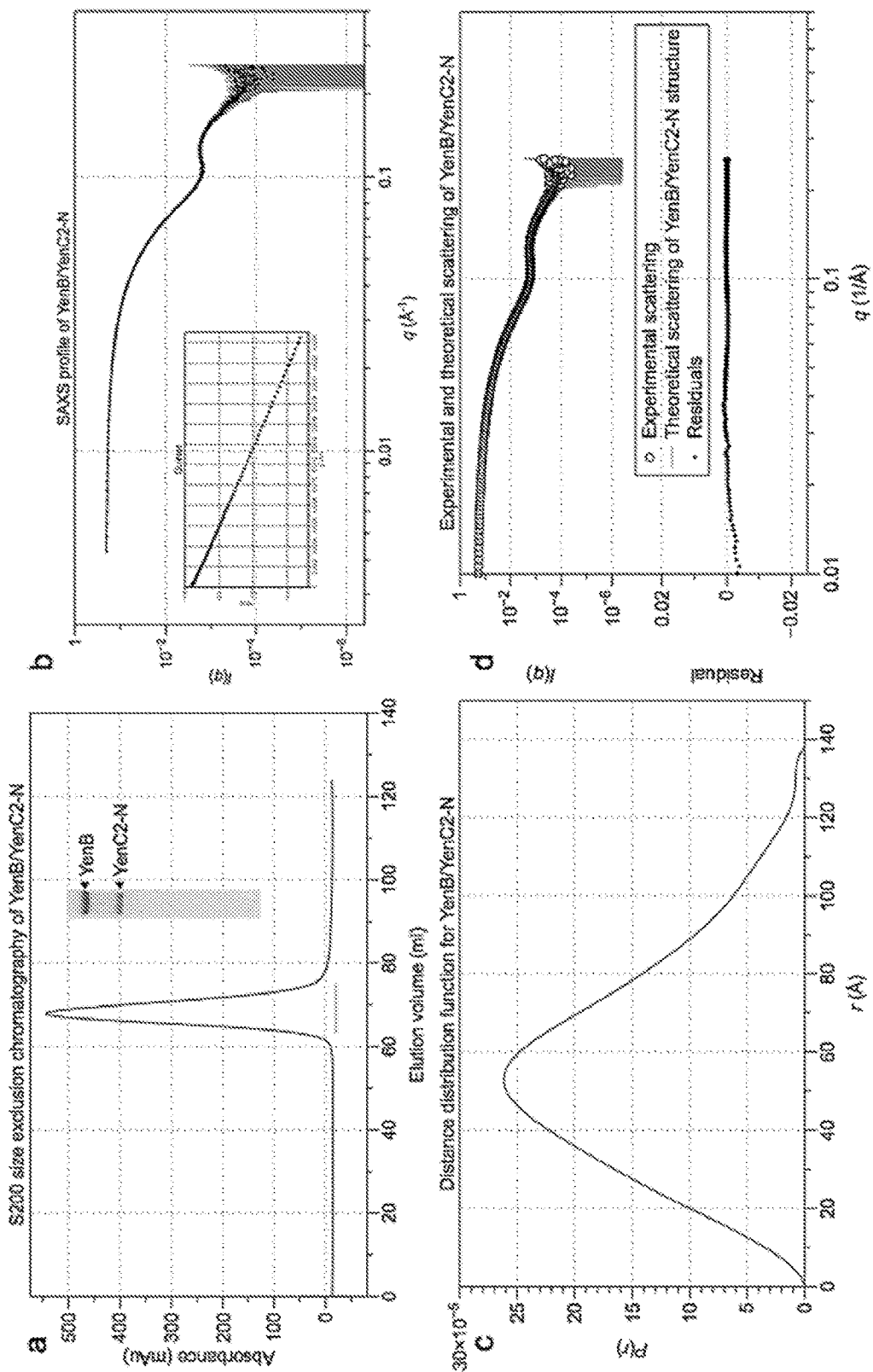
FIG. 7 shows SAXS data for YenB/YenC2. a, purity of YenB/YenC2 sample for SAXS analysis, shown by size exclusion chromatography trace and SDS-PAGE (inset). b, SAXS data for YenB/YenC2 as a log-log plot. Inset is a Guinier plot of the low-q region. c, P(r) plot for YenB/YenC2 with $D_{max}$=134 Å. d, scattering of YenB/YenC2 compared to the theoretical scattering of the YenB/YenC2-N crystal structure, highlighting the poor fit.
Figure 8:
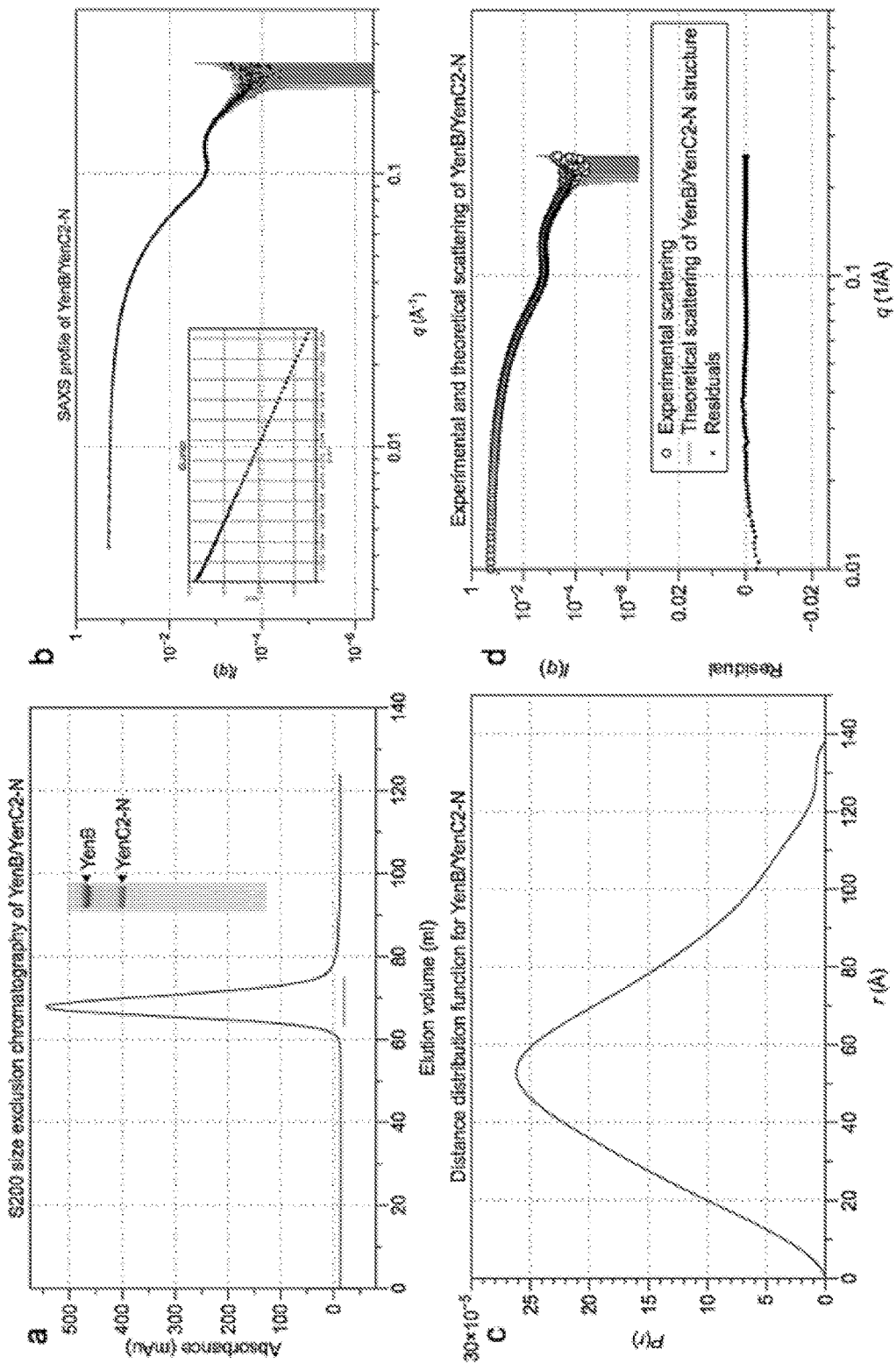
FIG. 8 shows SAXS data for YenB/YenC2-N. a, purity of YenB/YenC2-N sample for SAXS analysis, shown by size exclusion chromatography trace and SDS-PAGE (inset). b, SAXS data for YenB/YenC2-N as a log-log plot. Inset is a Guinier plot of the low-q region. c, P(r) plot for YenB/YenC2-N with $D_{max}$=138 Å. d, scattering of YenB/YenC2-N compared to the theoretical scattering of the YenB/YenC2-N crystal structure.
Figure 9:
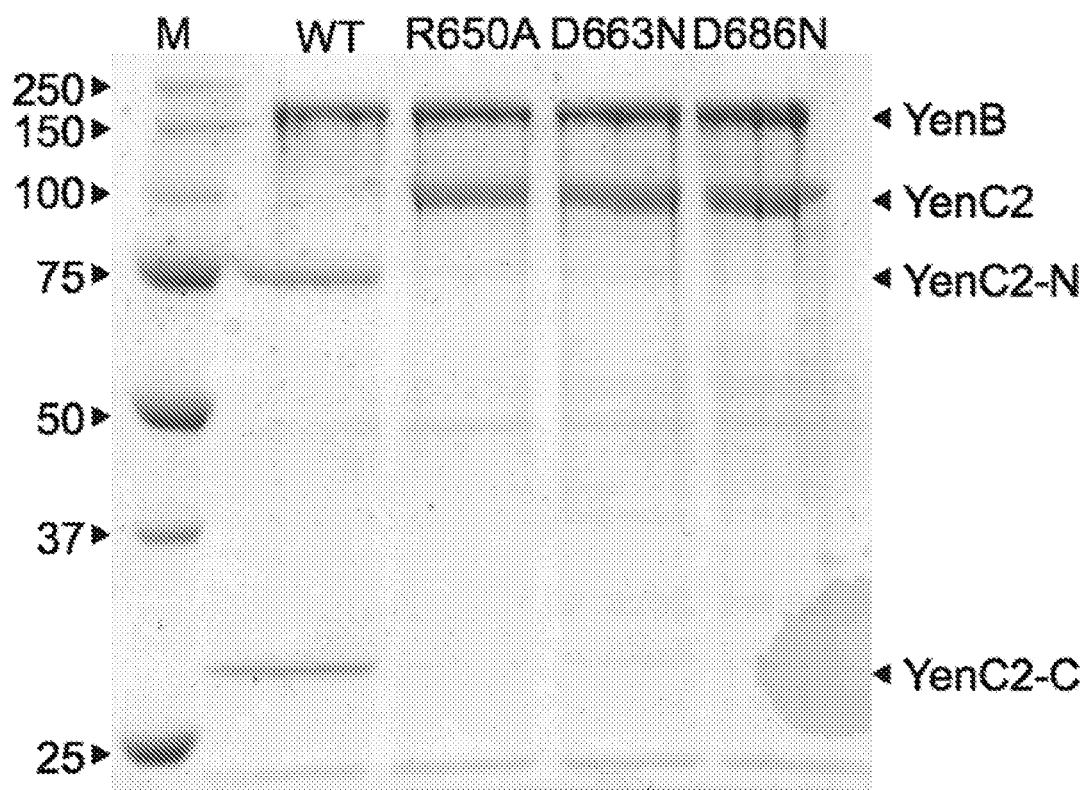
FIG. 9 shows the effect of point mutations on YenC2 self-cleavage. When co-expressed with YenB, wild-type YenC2 (WT) self-cleaves following M690. Three point mutations (R650A, D663N, and D686N) were found to abrogate self-cleavage.
Figure 10:
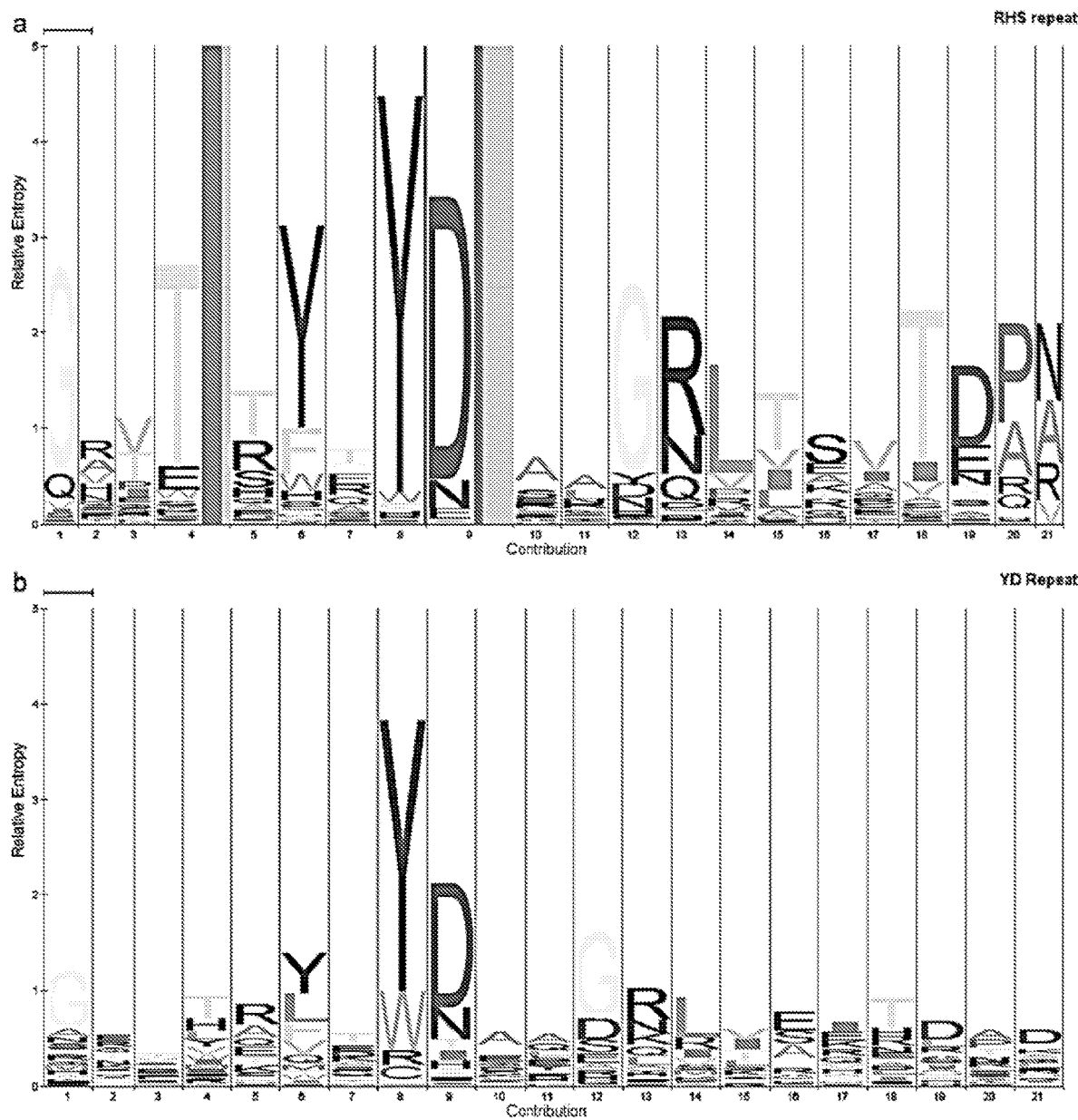
FIG. 10 profile-HMM logos of RHS and YD repeats. Profile-HMM logos of an RHS repeat (a) and a YD repeat (b) show that these two repeats have the same consensus sequence.

Small-angle X-ray scattering data were collected at the SAXS/WAXS beamline at the Australian Synchrotron (FIGS. 6, 7 and 8; Tables 8, 9, 10 and 11). Samples were purified to homogeneity by IMAC, and SEC and exhaustively dialysed against sample buffer containing 20 mM HEPES pH 7.5, 150 mM NaCl. The dialysate was used as the solvent blank. Data collection was carried out at 291 K with 1 or 2 second exposures. Sample was flowed across the beam at 4 μl/s to avoid radiation damage. Multiple concentrations were tested for each protein, and images for each concentration were compared, averaged and buffer-subtracted using the ScatterBrain software provided by the Australian Synchrotron. Scattering data were placed on the absolute scale by measuring the scattering of a water sample[30]. Ab initio bead models were created by running dammif[31] 20 times, superimposing and averaging the resulting models with damaver[32], and using this as input for a final refinement run of dammin[33]. SAXS data were compared with the theoretical scattering of the YenB/YenC2-N crystal structure using crysol[34].

TABLE 6

Data collection and refinement statistics for native YenB/YenC2-N dataset.

| | |
|---|---|
| Wavelength (Å) | 0.9537 |
| Resolution range (Å) | 49.55-2.26 (2.40-2.26) |

TABLE 6-continued

Data collection and refinement statistics for native YenB/YenC2-N dataset.

| | |
|---|---|
| Space group | $P2_12_12_1$ |
| Unit cell (Å) | 133.7 147.6 274.4 90 90 90 |
| Total reflections | 3,380,388 (245,257) |
| Unique reflections | 245,036 (33,576) |
| Completeness (%) | 97.3 (83.2) |
| Multiplicity | 13.8 (7.3) |
| Mean I/σ(I) | 9.81 (0.81) |
| $CC_{1/2}$ (%) | 99.1 (15.7) |
| Wilson B-factor | 37.69 |
| R-measure | 0.3129 (2.4219) |
| R-factor/R-free | 0.2075/0.2574 |
| Number of atoms | 35,548 |
| macromolecules | 33,027 |
| ligands | 54 |
| water | 2,467 |
| Protein residues | 4,240 |
| RMS (bonds) (Å) | 0.005 |
| RMS (angles) (°) | 0.99 |
| Ramachandran favored (%) | 96.00 |
| Ramachandran outliers (%) | 0.14 |
| Clashscore | 12.16 |
| Average B-factor | 48.20 |
| macromolecules | 48.30 |
| solvent | 46.80 |

Statistics for the highest-resolution shell are shown in parentheses.

TABLE 7

Data collection and refinement statistics for selenomethionine protein crystals.

| Dataset | SeMet 1 | SeMet 2 | SeMet 3 | SeMet 4 | Combined SeMet | $Ta_6Br_{12}$ soak |
|---|---|---|---|---|---|---|
| Wavelength (Å) | 0.979100 | 0.979100 | | | | 1.258000 |
| Resolution range (Å) | 94.11-2.78 (2.95-2.78) | 96.36-2.92 (3.09-2.92) | 96.32-2.91 (3.08-2.91) | 96.53-2.77 (2.94-2.77) | Dmid 21.45 (2.79) | 44.79-3.17 (3.20-3.17) |
| Space group | $P2_12_12_1$ | $P2_12_12_1$ | $P2_12_12_1$ | $P2_12_12_1$ | $P2_12_12_1$ | $P2_12_12_1$ |
| Unit cell (Å) | 134.6, 149.7, 276.0, 90, 90, 90 | 134.3, 150.5, 276.7, 90, 90, 90 | 134.3, 150.4, 276.6, 90, 90, 90 | 134.9, 150.3, 276.3, 90, 90, 90 | | 135.1, 152.9, 276.3, 90, 90, 90 |
| Total reflections | 375,898 (43,908) | 907,911 (136,715) | 917,907 (140,953) | 2,030,940 (227,949) | 4,226,680 (41,245) | 2,584,590 (112,511) |
| Unique reflections | 238,027 (33,377) | 234,490 (36,658) | 237,191 (37,874) | 271,549 (40,699) | 141,963 (5,905) | 89,256 (4,841) |
| Completeness (%) | 87.5 (75.8) | 99.4 (96.1) | 99.7 (98.4) | 98.6 (91.3) | 99.2 (84.4) | 90.6 (94.8) |
| Multiplicity | 1.6 (1.3) | 3.9 (3.7) | 3.9 (3.7) | 7.5 (5.6) | 29.8 (7) | 29.0 (23.2) |
| Mean I/σ(I) | 9.12 (1.64) | 5.91 (0.71) | 6.35 (0.75) | 10.67 (1.18) | 14.6 (1.1) | 13.9 (1.0) |
| $CC_{1/2}$ (%) | 99.5 (74.8) | 97.4 (20.5) | 97.9 (23.2) | 98.8 (60.1) | 99.5 (47.2) | 99.7 (38.8) |
| Anomalous correlation (%) | 22 (4) | 12 (2) | 13 (3) | 17 (0) | 13.8 (0) | 52.5 (9.5) |
| Anomalous resolution[1] (Å) | 11.1 | 6.7 | 6.6 | 5.5 | 5.0 | 5.68 |

Statistics for the highest-resolution shell are shown in parentheses.

[1] Anomalous resolution defined as the point at which $CC_{anom}$ drops below 0.3.

TABLE 8

Data collection and scattering derived parameters for YenB/YenC2 SAXS.

| Data-collection parameters | |
|---|---|
| Instrument | Australian Synchrotron SAXS/WAXS beamline |
| Beam geometry | point |
| Wavelength (Å) | 1.12713 |
| q range (Å$^{-1}$) | 0.009-0.614 |
| Exposure time | 2 s |
| Concentration range (mg/ml) | 5-0.15 |
| Temperature (K) | 291 |
| Structural parameters[1] | |
| I(0) (cm$^{-1}$) [from P(r)] | 0.190 |
| $R_g$ (Å) [from P(r)] | 42.0 |
| I(0) (cm$^{-1}$) [from Guinier] | 0.189 |
| $R_g$ (Å) [from Guinier] | 41.8 |
| $D_{max}$ (Å) | 134 |
| Porod volume estimate (Å$^3$) | 395,300 |
| Molecular mass determination[1] | |
| Partial specific volume (cm$^3$/g) | 0.7425 |
| Contrast ($\Delta\rho \times 10^{10}$/cm$^2$) | 2.1 |
| Molecular mass [from I(0)] (kDa) | 261.5 |
| Molecular mass [from SAXS-MoW] (kDa) | 253.8 |
| Calculated monomeric $M_r$ from sequence (kDa) | 276.3 |
| Software employed | |
| Primary data reduction | ScatterBrain |
| Data processing | GNOM |
| Ab initio analysis | DAMMIF & DAMMIN |
| Validation and averaging | DAMAVER |
| Three-dimensional graphics representations | PyMOL |

[1]data reported for 5 mg/ml concentration.

TABLE 9

Concentration dependence of SAXS data for YenB/YenC2.

| Concentration (mg/ml) | Guinier range | $R_g$ (Å) | $R_g$ standard deviation (%) | $I_0$/concentration |
|---|---|---|---|---|
| 5 | 5-18 | 41.8 | 0 | 0.189 |
| 2.5 | 3-17 | 42.7 | 0 | 0.193 |
| 1.25 | 7-17 | 42.7 | 0 | 0.176 |
| 0.31 | 7-17 | 42.9 | 1 | 0.161 |
| 0.15 | 16-38 | 41.8 | 1 | 0.147 |

TABLE 10

Data collection and scattering derived parameters for YenB/YenC2-N SAXS.

| Data-collection parameters | |
|---|---|
| Instrument | Australian Synchrotron SAXS/WAXS beam |
| Beam geometry | point |
| Wavelength (Å) | 1.12713 |
| q range (Å$^{-1}$) | 0.004-0.255 |
| Exposure time | 1 s |
| Concentration range (mg/ml) | 1-0.016 |
| Temperature (K) | 291 |
| Structural parameters[1] | |
| I(0) (cm$^{-1}$) [from P(r)] | 0.20 |
| $R_g$ (Å) [from P(r)] | 44.1 |
| I(0) (cm$^{-1}$) [from Guinier] | 0.20 |
| $R_g$ (Å) [from Guinier] | 44.2 |
| $D_{max}$ (Å) | 138 |
| Porod volume estimate (Å$^3$) | 365,000 |
| Molecular mass determination[1] | |
| Partial specific volume (cm$^3$/g) | 0.7425 |
| Contrast ($\Delta\rho \times 10^{10}$/cm$^2$) | 2.1 |
| Molecular mass [from I(0)] (kDa) | 277.0 |
| Molecular mass [from SAXS-MoW] (kDa) | 257.6 |
| Calculated monomeric $M_r$ from sequence (kDa) | 243.3 |
| Software employed | |
| Primary data reduction | ScatterBrain |
| Data processing | GNOM |
| Ab initio analysis | DAMMIF & DAMMIN |
| Validation and averaging | DAMAVER |
| Computation of model intensities | CRYSOL |
| Three-dimensional graphics representations | PyMOL |

[1]Data reported for 1 mg/ml concentration.

TABLE 11

Concentration dependence of SAXS data for YenB/YenC2-N.

| Concentration (mg/ml) | Guinier range | $R_g$ | $R_g$ standard deviation | $I_0$/concentration |
|---|---|---|---|---|
| 1 | 20-40 | 44.20 | 3% | 0.200 |
| 0.5 | 24-45 | 43.87 | 11% | 0.216 |
| 0.25 | 21-45 | 44.06 | 10% | 0.216 |
| 0.125 | 8-30 | 46.95 | 10% | 0.208 |
| 0.063 | 18-43 | 43.95 | 7% | 0.190 |
| 0.031 | 5-41 | 45.82 | 9% | 0.161 |
| 0.016 | 15-43 | 44.71 | 56% | 0.125 |

1. Bowen, D. et al. Insecticidal toxins from the bacterium *Photorhabdus luminescens*. *Science* 280, 2129-2132 (1998).
2. ffrench-Constant, R. H. & Waterfield, N. R. Ground control for insect pests. *Nat. Biotechnol.* 24, 660-661 (2006).
3. Hares, M. C. et al. The *Yersinia pseudotuberculosis* and *Yersinia pestis* toxin complex is active against cultured mammalian cells. *Microbiology* 154, 3503-3517 (2008).
4. Waterfield, N., Hares, M., Yang, G., Dowling, A. & ffrench-Constant, R. Potentiation and cellular phenotypes of the insecticidal Toxin complexes of *Photorhabdus* bacteria. *Cell. Microbiol.* 7, 373-382 (2005).
5. Lang, A. E. et al. *Photorhabdus luminescens* Toxins ADP-Ribosylate Actin and RhoA to Force Actin Clustering. *Science* 327, 1139-1142 (2010).
6. Landsberg, M. J. et al. 3D structure of the *Yersinia entomophaga* toxin complex and implications for insecticidal activity. *Proc. Nat. Acad. Sci. USA* 108, 20544-20549 (2011).
7. Gatsogiannis, C., Lang, A. E., Meusch, D. & Pfaumann. A syringe-like injection mechanism in *Photorhabdus luminescens* toxins. *Nature* 495, 520-523 (2013).
8. Hill, C. W., Sandt, C. H. & Vlazny, D. A. Rhs elements of *Escherichia coli*: a family of genetic composites each encoding a large mosaic protein. *Mol. Microbiol.* 12, 865-871 (1994).
9. Minet, A. D., Rubin, B. P., Tucker, R. P., Baumgartner, S. & Chiquet-Ehrismann, R. Teneurin-1, a vertebrate homologue of the *Drosophila* pair-rule gene ten-m, is a neuronal protein with a novel type of heparin-binding domain. *J. Cell Sci.* 112, 2019-2032 (1999).
10. Hurst, M. R. H., Jones, S. A., Binglin, T., Harper, L. A. & Glare, T. R. The main virulence determinant of *Yersinia entomophaga* MH96 is a broad host range insect active, Toxin Complex. *J. Bacteriol.* (2011).
11. Zhang, D., de Souza, R. F., Anantharaman, V., Iyer, L. M. & Aravind, L. Polymorphic toxin systems: Comprehensive characterization of trafficking modes, processing, mechanisms of action, immunity and ecology using comparative genomics. *Biol. Direct* 7, 18 (2012).
12. Buetow, L., Flatau, G., Chiu, K., Boquet, P. & Ghosh, P. Structure of the Rho-activating domain of *Escherichia coli* cytotoxic necrotizing factor 1. *Nat. Struct. Biol.* 8, 584-588 (2001).
13. Iyer, L M., Zhang, D., Rogozin, I. B. & Aravind, L. Evolution of the deaminase fold and multiple origins of eukaryotic editing and mutagenic nucleic acid deaminases from bacterial toxin systems. *Nucleic Acids Res.* 39, 9473-9497 (2011).
14. Jackson, A. P., Thomas, G. H., Parkhill, J. & Thomson, N. R. Evolutionary diversification of an ancient gene family (rhs) through C-terminal displacement. *BMC Genomics* 10, 584 (2009).
15. Wang, Y. D., Zhao, S. & Hill, C. W. Rhs elements comprise three subfamilies which diverged prior to acquisition by *Escherichia coli*. *J. Bacteriol.* 180, 4102-4110 (1998).
16. Mosca, T. J., Hong, W., Dani, V. S., Favaloro, V. & Luo, L. Trans-synaptic Teneurin signalling in neuromuscular synapse organization and target choice. *Nature* 484, 237-241 (2012).
17. Hong, W., Mosca, T. J. & Luo, L. Teneurins instruct synaptic partner matching in an olfactory map. *Nature* 484, 201-207 (2012).
18. Feng, K. et al. All four members of the Ten-m/Odz family of transmembrane proteins form dimers. *J. Biol. Chem.* 277, 26128-26135 (2002).
19. Chand, D. et al. C-terminal processing of the teneurin proteins: Independent actions of a teneurin C-terminal associated peptide in hippocampal cells. *Mol. Cell. Neurosci.* 52, 38-50 (2013).
20. Tucker, R. P. & Chiquet-Ehrismann, R. Teneurins: a conserved family of transmembrane proteins involved in intercellular signaling during development. *Dev. Biol.* 290, 237-245 (2006).
21. Xu, Z., Horwich, A. L. & Sigler, P. B. The crystal structure of the asymmetric GroEL-GroES-(ADP)_7 chaperonin complex. *Nature* 388, 741-750 (1997).
22. McPhillips, T. M. et al. Blu-Ice and the Distributed Control System: software for data acquisition and instrument control at macromolecular crystallography beamlines. *J. Synchrotron Radiat.* 9, 401-406 (2002).
23. Kabsch, W. XDS. *Acta Cystallogr. D* 66, 125-132 (2010).
24. The CCP4 suite: programs for protein crystallography. *Acta Crystallogr. D* 50, 760-763 (1994).
25. Panjikar, S., Parthasarathy, V., Lamzin, V. S., Weiss, M. S. & Tucker, P. A. Auto-rickshaw: an automated crystal structure determination platform as an efficient tool for the validation of an X-ray diffraction experiment. *Acta Crystallogr. D* 61, 449-457 (2005).
26. Panjikar, S., Parthasarathy, V., Lamzin, V. S., Weiss, M. S. & Tucker, P. A. On the combination of molecular replacement and single-wavelength anomalous diffraction phasing for automated structure determination. *Acta Crystallogr. D* 65, 1089-1097 (2009).
27. Adams, P. D. et al. PHENIX: a comprehensive Python-based system for macromolecular structure solution. *Acta Cystallogr. D* 66, 213-221 (2010).
28. Schrodinger, L. L. C. The PyMOL Molecular Graphics System, Version 1.3r1. (2010).
29. Pettersen, E. F. et al. UCSF Chimera—a visualization system for exploratory research and analysis. *J. Comput. Chem.* 25, 1605-1612 (2004).
30. Orthaber, D., Bergmann, A. & Glatter, O. SAXS experiments on absolute scale with Kratky systems using water as a secondary standard. *J. Appl. Crystallogr.* 33, 218-225 (2000).
31. Franke, D. & Svergun, D. I. DAMMIF, a program for rapid ab-initio shape determination in small-angle scattering. *J. Appl. Cystallogr.* 42, 342-346 (2009).
32. Volkov, V. V. & Svergun, D. I. Uniqueness of ab initio shape determination in small-angle scattering. *J. Appl. Cystallogr.* 36, 860-864 (2003).
33. Svergun, D. I. Restoring low resolution structure of biological macromolecules from solution scattering using simulated annealing. *Biophys. J.* 76, 2879-2886 (1999).
34. Svergun, D., Barberato, C. & Koch, M. H. J. CRYSOL-a program to evaluate X-ray solution scattering of biological macromolecules from atomic coordinates. *J. Appl. Crystallogr.* 28, 768-773 (1995).
35. Busby, J. N. et al. Structural Analysis of Chi1 Chitinase from Yen-Tc: The Multisubunit Insecticidal ABC Toxin Complex of *Yersinia entomophaga*. *J. Mol. Biol.* 415, 359-371 (2012).

Example 2: Demonstrating Activity by Expressing Toxin Proteins in *E. coli* and Feeding to Insects Cloning and Expression The encapsulated proteins of the invention can be expressed using commercially available non-conjugative vectors such as pET in *E. coli* (GATEWAY® technology, Invitrogen).

Once the gene expression has been established, by methods well-known to those skilled in the art, the transformed *E. coli* (as a bacterial cell in broth culture) can be used in a standard bioassay against, for example, diamondback moth (DBM) and other insects, to demonstrate insecticidal activity.

The kit uses Transform One Shot® Chemically Competent *E. coli*. The pET vectors carry a bacteriophage T7 promoter, transcription and translation signals. The source of T7 RNA polymerase is provided by the host cells.

Bioassay Methods

Diamondback Moth, *Plutella xylostella* (Lepidoptera: Plutellidae), Cabbage White Butterfly, *Pieris rapae* (Lepidoptera: Pieridae) and Cabbage Looper Moth, *Trichoplusia ni* (Lepidoptera: Noctuidae)

Diamondback moth larvae can be reared on *brassica* (cabbage plants), or the strains resistant to Cry1A and Cry1C and a susceptible (G88) strain can be obtained and tested at the New York State Agricultural Experiment Station, College of Agriculture and Life Sciences at Cornell University, located in Geneva, N.Y., USA. Cabbage white butterfly larvae can be field-collected.

Ten $2^{rd}$-$3^{rd}$ instar larvae can be used and placed on 3 cm disc of cabbage leaf treated with either 20 μl of transformed *E. coli* solution, or dipped in the solution. A wetting agent, Siliwet L-77 (Momentive Performance Materials, New York, USA) or Triton X-100 (Rohm and Hass Co, Philadelphia, USA) is used at <0.05%. Each treatment can be replicated 3-5 times (3-50 larvae per treatment). Treated larvae remain on the cabbage leaf at 23° C. 16L:8HD (Lincoln) or at 27° C. 16hL:8hD (USA) and are checked daily for dead larvae.

Example 3: Demonstrating Activity in Transgenic Plants and in Plant Bioassay

Cloning

Genetic Constructs Used in the Transformation Protocol

Sequences for expressing the encapsulated proteins of the invention can be cloned into suitable constructs and vectors for transformation of plants as is well known by those skilled in the art, and disclosed herein.

For example, the plant transformation vector, pHZBar is derived from pART27 (Gleave 1992, Plant Mol Biol 20: 1203-1207). The pnos-nptII-nos3' selection cassette has been replaced by the CaMV35S-BAR-OCS3' selection cassette with the bar gene (which confers resistance to the herbicide ammonium glufosinate) expressed from the CaMV 35S promoter. Cloning of expression cassettes into this binary vector is facilitated by a unique NotI restriction site and selection of recombinants by blue/white screening for β-galactosidase.

The polynucleotide sequences encoding the encapsulated proteins of the invention can be cloned by standard techniques into pART7 downstream of the 35S promoter. A unique NotI fragment can then be shuttled into pART27 (Gleave, 1992, Plant Mol Biol 20: 1203-1207) for transformation of various plant species. This binary vector contains the nptII selection gene for kanamycin resistance under the control of the CaMV 35S promoter. Genetic constructs in pART27 can be transferred into *Agrobacterium tumefaciens* strain GV3101 or EHA105 as plasmid DNA using freeze-thaw transformation method (Ditta et al 1980, Proc. Natl. Acad. Sci. USA 77: 7347-7351). The structure of the constructs maintained in *Agrobacterium* can be confirmed by restriction digest of plasmid DNA's prepared from bacterial culture. *Agrobacterium* cultures can be prepared in glycerol and transferred to −80° C. for long term storage. Genetic constructs maintained in *Agrobacterium* strain GV3101 can be inoculated into 25 mL of MGL broth containing spectinomycin at a concentration of 100 mg/L. Cultures can be grown overnight (16 hours) on a rotary shaker (200 rpm) at 28° C. Bacterial cultures can be harvested by centrifugation (3000×g, 10 minutes). The supernatant is removed and the cells resuspended in a 5 mL solution of 10 mM $MgSO_4$.

Plant Transformation

Plants can be transformed to express the encapsulated proteins of the invention by numerous methods well known to those skilled in the art and disclosed herein.

Tobacco Transformation

Tobacco can be transformed via the leaf disk transformation-regeneration method (Horsch et al. 1985). Leaf disks from sterile wild type W38 tobacco plants are inoculated with an *Agrobacterium tumefaciens* strain containing the appropriate binary vector, and cultured for 3 days. The leaf disks are then transferred to MS selective medium containing 100 mg/L of kanamycin (or 5 mg/L of glufosinate) and 300 mg/L of cefotaxime. Shoot regeneration occurs over a month, and the leaf explants are placed on hormone free medium containing kanamycin or glufosinate for root formation.

*Sorghum* Transformation

The constructs described above can also be used to transform *Sorghum*. A suitable protocol for transforming *Sorghum* is found in Howe et al., 2006, Plant Cell Reports, Volume 25, No 8, 784-791.

Cotton Transformation

The constructs described above can also be used to transform cotton. A suitable protocol for transforming cotton is found in U.S. Pat. No. 5,846,797.

Wheat Transformation

The constructs described above can also be used to transform wheat. A suitable protocol for transforming wheat is found in Ortiz et al., 1996, Plant Cell Rep. 15, 1996, 877

Maize Transformation

The constructs described above can also be used to transform maize. A suitable protocol for transforming maize is found in U.S. Pat. No. 8,247,369.

Transformation of Other Plants

Transformation protocols for other plants are well-known to those skilled in the art, and are disclosed herein.

ELISA Assay

ELISA analysis according to the method disclosed in U.S. Pat. No. 5,625,136 can be used for the quantitative determination of the level of the encapsulated proteins in transgenic plants, or parts thereof.

Bioassay

Various parts of the transformed plants, or whole plants can be used in standard insect bioassay procedures to test the activity of the encapsulated proteins of the invention, and the resistance of the transformed plants to various insects.

Numerous suitable methods are known to those skilled in the art and are described for example in the following US patents: U.S. Pat. Nos. 8,247,369; 8,216,806; 8,173,872; 8,034,997; 7,858,849; and 7,803,993; 7,655,838 and 7,919, 609; all of which are incorporated herein by reference.

Example 4: Demonstrating Encapsulation of a Foreign Protein

Figure 16:
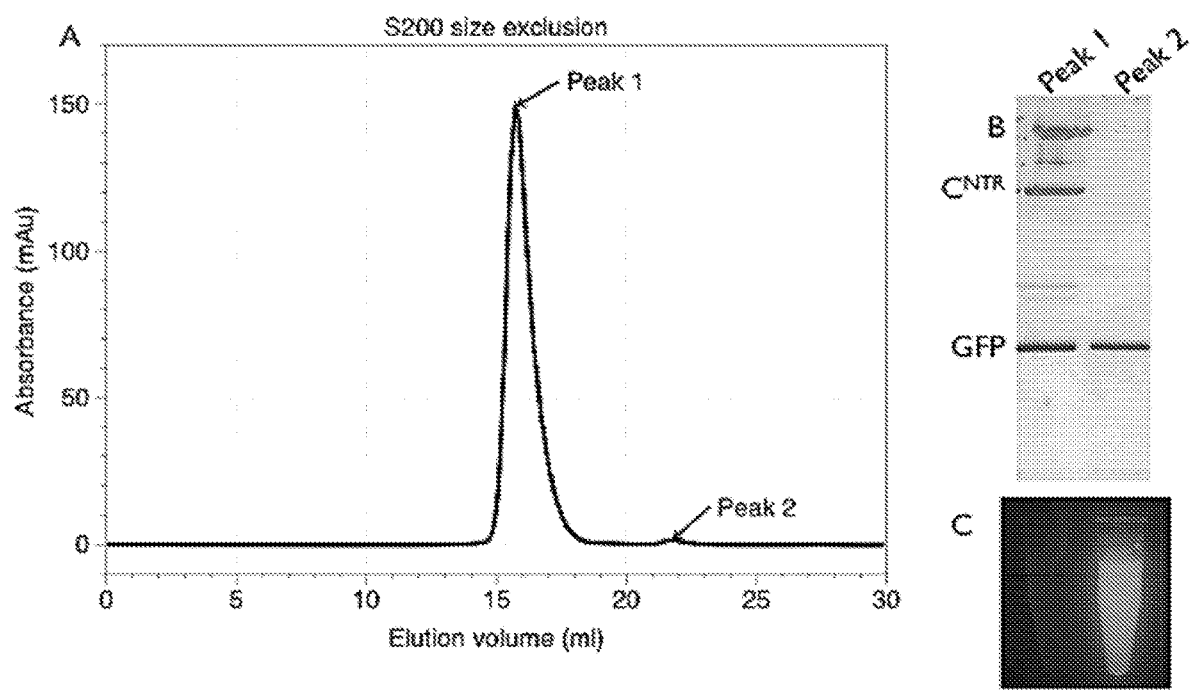
FIG. 16. a, Size exclusion chromatography trace of TcB: TcC-GFP fusion at pH17.5; b, SDS-PAGE of fractions from size exclusion trace in panel a). Peak1—GFP encapsulated in TcB:TcC shell, Peak 2 non bound GFP; c, left microcentrifuge tube contains protein from Peak 1 (no fluorescence) and right microcentrifuge tube contains released GFP from Peak 2 (fluorescence under UV illumination).

The applicants have created versions of the TcB/TcC (BC) complex in which the C-terminal region of YenC2 (TcC) has been replaced with green fluorescent protein (GFP). Two versions of this construct have been created, the native-GFP version, in which GFP has a net negative charge, and a version containing a modified GFP with a net positive charge (GFP+6), mimicking the charge of the normal TcC. Both constructs have been expressed in *E. coli* and purified by standard procedures (immobilized metal ion affinity chromatography [IMAC], and size exclusion chromatography [SEC]). The GFP protein is produced as a fusion of the N-terminal region of YenC2 (YenC2NTR) and GFP. This fusion protein was expected to self-cleave at the boundary between these two proteins, analogous to the cleavage that occurs in the native complex. This cleavage occurs with both the native GFP and GFP+6 variants, and the protein complex consisting of YenB, the N-terminal region of YenC2 (YenC2NTR), and GFP co-purify and form a single peak on size exclusion. This indicates that GFP is being encapsulated within the BC shell, in a similar manner to the native TcC. This protein complex does not fluoresce, suggesting that GFP is encapsulated in an unfolded state. After storage for several days, fluorescence was observed with the native-GFP-containing complex. When this was again subjected to SEC, a major peak consisting of all three complex proteins (YenB, YenC2NTR, GFP) was observed (FIG. 16 A-B), which did not fluoresce (FIG. 16 C). A smaller peak was also observed consisting of GFP alone, which did fluoresce (FIG. 16 B-C). This indicates that there has been some slow leakage of GFP from the complex, at which point GFP folds and is able to fluoresce. This leakage occurred at a reduced rate in the positively-charged GFP+6 variant.

Materials and Methods

*Yersinia entomophaga* YenB and YenC2 were cloned into the pETDuet-1 co-expression vector using standard cloning techniques. Expression was performed in *E. coli* Rosetta2 (DE3) cells using ZYM-5052 auto-induction medium (Studier, 2005). Freshly transformed cells were grown in 5-ml LB cultures overnight and used to inoculate 500-ml ZYM-5052 cultures in 2 litre baffled flasks. These were incubated at 37° C. for 4 hours, followed by 18° C. for 24 hours. Cultures were harvested by centrifugation at 4,680 RCF for 30 minutes and cell pellets were either frozen at −20° C. or used immediately. Cell pellets were resuspended in his-0 buffer (20 mM HEPES pH 7.5, 150 mM NaCl, 1 mM 2-mercaptoethanol) with the addition of Roche Complete mini EDTA-free protease inhibitor tablets, according to the manufacturer's directions. Cells were lysed by passage through a continuous-flow cell disrupter (Microfluidics microfluidizer M-110P) at a pressure of 18 MPa. Cell lysate was clarified by centrifugation at 27,000 RCF for 30 minutes followed by filtration. The protein complex was purified by IMAC using a 5-ml Talon HiTrap column. The protein complex was washed with his-0 buffer and eluted with his-150 buffer (identical to his-0 with the addition of 150 mM imidazole). This eluted fraction was concentrated and dialysed against his-0 buffer overnight at 4° C. with the addition of TEV protease (Blommel & Fox, 2007) to remove the his-tag. This protein was subsequently applied to the same Talon HiTrap column and the flow-through collected. This was then concentrated and applied to a HiLoad 16/60 Superdex 200 size exclusion column (GE) attached to an Äkta prime FPLC system. His-0 buffer was pumped over the column at a rate of 1 ml/minute, and fractions were collected and analysed by SDS-PAGE. Analytical size exclusion was performed using a Superdex 200 10/300 analytical column (GE). GFP fluorescence was determined by illumination with blue light and observation under a yellow filter.

REFERENCES

Blommel, P. G., & Fox, B. G. (2007). A combined approach to improving large-scale production of tobacco etch virus protease. Protein Expression and Purification, 55(1), 53-68. doi:10.1016/j.pep.2007.04.013.

Studier, F. W. (2005). Protein production by auto-induction in high density shaking cultures. Protein Expression and Purification, 41(1), 207-234.

SEQUENCE LISTING (140 sequences)

SEQ ID NO: 1 - protein, 1164 aa, Yersinia entomophaga
MDKYNNYSNVIKNKSSISPLLAAAAKIEPEITVLSSASKSNRSQYSQSLADTLLGLGYRSIFDIAKVSRQRFIKRHDESLLGNGAVIFDKAVSMANQVLQKYRKNRLEKSNSPLVPQTSSSTDASSESQTNKLPEYNQLFPEPWDNFCRPGAIEALDSPASYLLDLYKFIQSVELDGSNQARKLETRRADIPKLSLDNDALYKEVTALSIVNDVLSGSAREYIDQSGQADKAVNQILGDTHFPFTLPYSLPTQQINKGLGASNIELGTVIQRVDPQFSWNTTQEKYNQVLLAYTQLSSEQIALLSLPDVFTQNFLTQTELSAGYLSASTTEILAEKDLSRHGYIVKAADNIKGPTQLVEHSDASYDVIELTCTNQAKETITVKLRGENIITYQRTKARMVPFDNSSPFSRQLKLTFVAEDNPSLGNLDKGPYFANMDIYAAEWVRENVSSETMVSRPFLTMTYRIAIAKAGASLEELQPEADAFFINNFGLSAEDSSQLVKLVAFGDQTGSKAEEIESLLSCGENLPIVSPNVIFANPIFGSYFNDEPFPAPYHFGGVYINAHQRNAMTIIRAEGGREIQSLSNFRLERLNRFIRLQRWLDLPSHQLDLLLTSVMQADADNSQQEITEPVLKSLGLFRHLNLQYKITPEIFSSWLYQLTPFAVSGEIAFFDRIFNREQLFDQPFILDGGSFTYLDAKGSDAKSVKQLCAGLNISAVTFQFIAPLVQSALGLEAGTLVRSFEVVSSLYRLVSIPQTFGLSTEDGLILMNILTDEMGYLAKQPAFDDKQTQDKDFLSIILKMEALSAWLTKNNLTPASLALLLGVTRLAVVPTNNMVTFFKGIANGLSENVCLTTDDFQRQELEGADWWTLLSTNQVIDDMGLVLDIHPVWGKSDEEMLMEKIQSIGVSNDNNTLSIIVQILIQAKNAQENLLSQTISAEYGVERSVVPLQLRWLGSNVYSVLNQVLNNTPTDISSIVPKLSELTYSLLIYTQLINSLKLNKEFIFLRLTQPNWLGLTQPKLSTQLSLPEIYLITCYQDWVVNANKNEDSIHEYLEFANIKKTEAEKTLVDNSEKCAELLAEILAWDAGEILKAASLLGLNPPQATNVFEIDWIRRLQTLSEKTMISTEYLWQMGDLTENSEFSLKEGVGEAVMAALKAQGDSDNV

SEQ ID NO: 2 - protein, 1360 aa, Yersinia entomophaga
MSNSIEAKLQEDLRDALVDYYLGQIVPNSKDFTNLRSTIKNVDDLYDHLLLDTQVSAKVITSRLSLVTQSVQQYINRIALNLEPGLSINQQEATDWEEFANRYGYWAANQQLRMFPEIYVDPTLRLTKTEFFFQLESALNQGKLTDDVAQKAVLGYLNNFEEVSNLEIIAGYQDGIDIENDKTYFVARTRMQPYRYFWRSLDASQRNANSQELYPTAWSEWKAISVPLENVANGIVRPIMMDNRLYISWFEVAEEKETDSDGNIIVSGRYRTKIRLAHLGFDGVWSSGTTLREEVLADQMEEMIAVVDRMEDEPRLALVAFKEMSESWDVVFSYICDSMLIESSNLPTTTHPPKPGDGDKGLSDLDDYGANLVWFYLHETANGGKAEYKQLILYPVIINRDWPIELDKTHQGDFGTVDDFTLNSNYTGDELSLYLQSSSTYKYDFSKSKNIIYGIWKEDANNNRCWLNYKLLTPEDYEPQINATLVMCDKGDVNIITGFSLPNGGVDAGGKIKVTLRVGKKLRDKFQIKQFSQTQYLQFPEASSADVWYIGKQIRLNTLFAKELIGKASRSLDLVLSWETQNSRLEEAILGGAAELIDLDGANGIYFWELFFHMPFMVSWRFNVEQRYEDANRWVKYLFNPFECEDEPALLLGKPPYWNSRPLVDEPFKGYSLTQPSDPDAIAASDPIHYRKAVFNFLTKNIIDQGDMEYRKLQPSARTLARLSYSTASSLLGRRPDVQLTSFWQPLTLEDASYKTDAIEMQSQPLTFEPVVHDQTMSAVDNDIFMYPMNNELRGLWDRIENRIYNLRHNLTLDGKEINMDLYDSSISPRGLMKQRYQRVVTARNASKMNFKVPNYRFEPMLNRSKSGVETLIQFGSTLLSLLERKDSLSFDAYQMIQSGDLYRFSIDLQQQDIDINKASLEALQVSKQSAQDRYDHFKELYDENISSTEQKVIELQSQAANSLLMAQGMRTAAAALDVIPNIYGLAVGGSHWGAPLNAAAEIIMIKYQADSSKSESLSVSESYRRRRQEWELQYKQAEWEVNSVEQQINLQNMQIKAANKRLEQVEAQQQQAMALLDYFSERFTNESLYTWLISQLSSLYLQAYDAVLSLCLSAEASLLYELNLGEQSFVGGGGWNDLYQGLMAGETLKLALMRMERVYVEQNSRRQEITKTISLKALLGESWPAELNKLKQKTPINFNLEEQIFVEDYQELYQRRIKSVSVSLPMLVGPYEDVCAQLTQTSSSYSTRADLKTVENMLTKRTFADTPHLVRSIQPNQQISLSTGVNDSGLFMLNFDDERFLPFEGSGVDSSWRLQFTNLKQNLDSLNDVILHVKYTAAIGSSTFSQGVRKILANINNDE

SEQ ID NO: 3 - protein, 2517 aa, Xenorhabdus bovienii
MYSTAVLLNKISPTRDGLTMTLADLQHLSFSELRKTFDDQLSWGESHYLYREAVEQKKRHRLLEARIFTCANPQLSGAIRRGIEQDDASRSYDKMFGSRSSSFVNPGSVASMFSPAGYLTELYREAKDLHFTSSAYHLDNRRPDLADLTLSQNNMDSEISTLALSNELLLAHITRQTGGDSDALMEILSTYRKAVDTPYHQPYETVRQVIMAHDSTLSALSRNPEVMAQAEGASLLAIQANISPELYHVLTEEITEENADTLFAKNFSENITPENFASQAWIAKHYGLELSDVQKYLGILQNGYSDNTSVYVDNISTGLVADDEGKLDAYKITRIPGGDYAKHLNFWDLLYKGDSDFVIRANFKKSSGGLTIRKSGVGTTNDSKVIGTISAPTDANTVYQSEILSPLTVDDLKNGATIFAYNRGGNKNIEGTAVFTFESYPLSIFALKLNKAIRLCLASELSPNELQTIVLSDNAQGIINNSVLTKVFYTLFYSTRYALSADDAQVLNGSVINQYADDDSVSHFNRIFNTPPLKGKIFEADGNTVSIDPNEEPATFACSALIRGLGINSGELYQLGRLAGVLDTKNNITLSVSVISSLYRLKLLAHTHQLTVNELCMLYGFSPFRGKATASLSSGELAQLVIWLYQVTQWLTEAAITTEELWLLCTPEFSGNISPEINNLLNTLRPRISEDMAQGGDRELQAEILAPFIAATLHLASPDMARYILLWTDNLRPGGLNIAGFMTRVLKETLSPDETIQLVQFCHVMAQLSLSVQTLRLSEAELSVLVISGFTVLGVRSQPAGQHNIDTLFSLYRFHQWINALGNLSSDTLDMLRQQTLTADRLASVMGLDISMVTQAIACADVSSLQSWQNINAVLQWMDVASELHTMPSVIRRLVNIRYVTVPNKAESDLPSWDEWQTLAENMEAGLSTQQAQALADHTAERLSSVLCHWFLANIQPEGIFLQSRDDLYSYFLIDNQVSSAIKTTRLAEAIAGIQLYINRALNRIESNARADVSTRQFFTDWAMNNRYSTWGGVSRLVYYPENYIDPTQRIGQTRMMDELLENISQSKLSRDTVEEAFKTYLTRFETVADLKVVSAYHDNVNSDSGLIWFVGQTRENLPDYYWRNVDISRRQAGKLAANAWKEWTKIDTAVTPYKDVIRPVVFKERLHLIWVEKEEVAENGTDPVKTSDRFTLKLAFLRHDGSWSAPWSYDITTQVKAVTDDKPDAERLGLAASGFQGEDTLLVFVYKTGESYPDFGGSNKNVAGMVIYGDGSLKQMDSTALSRYSPLKNTFDTINTKDNNLVRKASYRFAQDFEVPTSLNMGSAQDDRHLVVIENAAIPEITSQSSSESFTITLQNATFTVRYDGSGNALRSKQIRAMKLGGLGGLPGDDFILANSARYAGGVRDLGGPIAIYNKTKNYIISVQDSYEPSLHLRYLRLSPINDSGPILISPAPSYPKDGTNVIAYLGGDRSSDFKKCYYAFDRGNKKIGPFQDWSSYYSYGGWLEVGSGANPAGTQITVVAGSKPYHFTAENHAVSLPPNSFEGMQYTFKPLVIDAAGLVYLNNAAPVDITFEVEGMGKISQTLTVRKLDYGQENILCLQETDTGVQYMQLGVYRIRLNTLLAPKLVSRANTGIDTILTMATQQLPEPQLGKGFYATFTLPPYNPATHGTSRAFKLNLKHVVDDNVHIIYSGLLQDTELAVRLFIPLDDTPLYEKFIAKVFLTTQKNPNDVPWAGPHFTDDSGKIGIHGSSNVSMFTGVQPHNGTTTEPLDFNSACALYYWELFYYTPMMCFQRLLQEKQFDDATKWMNYVYNPAGYIVHGEIAPWIWNCRPLEETTSWHANPLDAIDPDAVAQNDPTHYKVATFMRLLDQLITRGDMAYRELTRDALNEAKMWYVRTLELLGDEPEDYGSSQWAAPSLSMAASQTVQAAYQQDLTALDSGEVSMQPRTANSLVGLFLPEYNPALTDYWKTLRLRLFNLRNNLSIDGQPLSLAIYAEPTDPQALLTSMVQASQGGSVLPTGTLSLYRFPVMLERARNLGAQLTQFGASLLSMAEHDDADELTTLLLQQGMELSTQSIRIQQRTVDEVDADITVLAESRRSAQNRLEKYQQLYDEDINHGEQRAMSLFDAAAGQSLAGQVLTAAEGVADLVPNVFGFACGGSRWGSALRAAASVISLSATASQYSAEKISRSETYRRRRQEWEIQRDNADGEIRQMDAQLEALKIRREAAQMQVEYQETQQAQTQTQLELLQRKFTNKALYSWMRGKLSAIYYQFFDLTQSFCLMAQEALRRELSDNGVTFIRGGAWNGTTAGLMAGETLLLNLAEMEKAWLERDERALEVTRTVSLVQVYQALSSDSFSLTEKLTQFLSEGKGSAGTSGNELKLSSGQIAASVRLSDLNIFGDYPESLGRTRQLKQVSVTLPALVGPYEDIRAVLNYGGSVMMPRGCSAIALSHGMNDSGQFVLDFNDARYLPFEGIPVDDSGSLTLSFPDATDRQKEILQSLSDIILHIRYTIRS

SEQ ID NO: 4 - protein, 965 aa, Photorhabdus luminescens
MNQLASPLISRTEEIHNLPGKLTDLGYTSVFDVVRMPRERFIREHRADLGRSAEKMYDLAVGYAHQVLHHFRRNSLSEAVQFGLRSPFSVSGPDYANQFLDANTGWKDKAPSGSPEANDAPVAYLTHIYQLALEQEKNGATTIMNTLAERRPDLGALLINDKAINEVIPQLQLVNEILSKAIQKKLSLTDLEAVNARLSTTRYPNNLPYHYGHQQIQTAQSVLGTTLQDITLPQTLDLPQNFWATAKGKLSDTTASALTRLQIMASQFSPEQQKIITETVGQDFYQLNYGDSSLTVNSFSDMTIMTDRTSLTVPQVELMLCSTVGGSTVVKSDNVSSGDTTATPFAYGARFIHAGKPEAITLSRSGAEAHFALTVNNLTDDKLDRINRTVRLQKWLNLPYEDIDLLVTSAMDAETGNTALSMNDNTLRMLGVFKHYQAKYGVSAKQFAGWLRVVAPFAITPATPFLDQVFNSVGTFDTPFVIDNQDFVYTLTTGGDGARVKHISTALGLNHRQFLLLADNIARQQGNVTQSTLNCNLFVVSAFYRLANLARTLGINPESFCALVDRLDAGTGIVWQQLAGKPTITVPQKDSPLAADILSLLQALSAIAQWQQQHDLEFSALLLLLSDNPISTSQGTDDQLNFIRQVWQNLGSTFVGATLLSRSGAPLVDTNGHAIDWFALLSAGNSPLIDKVGLVTDAGIQSVIATVVNTQSLSDEDKKLAITTLTNTLNQVQKTQQGVAVSLLAQTLNVSQSLPALLLRWSGQTTYQWLSATWALKDAVKTAADIPADYLRQLREVVRRSLLTQQFTLSPAMVQTLLDYPAYFGASAETVTDISLWMLYTLSCYSDLLLQMGEAGGTEDDVLAYLRTANATTPLSQSDAAQTLATLLGWEVNELQAAWSVLGGIAKTTPQLDALLRLQQAQNQTGLGVTQQQQGYLLSRDSDYTLWQSTGQALVAGVSHVKGSN

SEQ ID NO: 5 - protein, 1094 aa, Burkholderia pseudomallei
MSTLEEQLETQYLSESLRDALADAGEMSVQEAAALAQSEALPTDLVPWRDEIVQAAAIVRASVRDAWVSHDPTTRASPHFHEPDPELRNLPVETGEFCDPDSLQSKLSPARYLMQIYGTATKQITPTDEQRRLETRRPDLKDLALTSDHLLTEVTTLSLANQAMEALAKTPSQERDELYKKLATDRSAFSLPFDSYQTRVRLGLAALDGASLNGIARATSSDANVLVSANWALVPNPRDRLGLCDEDMAILTATAGADDAKQLWDVEKFLSHTSISLDDLNLLICSSGIRAEDGVASPDRVAAYYAKYINRGTPPAIRVAKVNAGVNEGKLALMRGTGLTTTEYLGNMERMVRLYRRTGLPFHQLDHLICTAAMLENRNPPLLNDFALSLIARYREWHARFGLSVDAYVGLMYWSNEFVREGLQEMSYLRQQFGDAAQWIARYCAAEVSEEKKYLRNPHVPIRQRLTAEEIAALQRGLQLTQTDWDTIVGAIDPRMDRAFDWPCVAALQRFSRPFRSFGWSVQDAVLMLQQIAQIQLTKLSEGGKDVLGTLDQLVWLNDTLTAWQATPAQIVTIVRTPPDEALKATQETANWINDLHQNLLPTLLTASSFDSYETVPLDTPATSPVTIDWLAELQKAPAAVNAIGLVLNHTKAEFETKVQNVLVAKGASRATSMKDGVVATLLLAQTSAMAALSAAVAKRMSGASDVVIPMLAWMNLQDSLKDPINYYTVLDKLLTWNLGNKGAIDVPTLNQQSDTLKLLALMSRYAEAVRLFRLEREDIRLVVDRPEAFGALRQKLSLNFDLLLALGRLKGLQHDQAGADAWRMYFTRRATAAAERDPNRKAAQIAALTDTLSQLLGCPVEELKLMLDDLPTPVKELPDTVQEVDLMHRHLVQARALALDYAQLKPVKTMATRTGYGSEGSRDGDRLPWADKRTAADAVMTGVARYGALATAVDHPLDEACRDALVGYLLKKSSPTNGFKMSPTPSSSIVTCCSTSTSRARSAPPNCWKRPAPSSYTSTARWKGPSQQRSSRIPLSAMRQATPPSARWSTNGPSIANTSCGEPTRSSACSLPTMSTRNGYKTRVPTIWPSPTR

SEQ ID NO: 6 - protein, 2552 aa, Burkholderia pseudomallei
MGNYLLRQVTLAFDRAIEQCLARLNAQAFSRGDVVNTQTLSRLQSSIEPLGIKTLIEIALFSFDEFRNKVRDVLSWHETRVMYRAAQRSLNESRLYEALLLSRSNPQLSQAVGLAIAPPRVQLHDYESMLGQRASQYVAPGSVASMFSPAAYLTEMYREARALHYANFPYHLGVRRPDLATLVLSQSNLDESLSMLDLSNEILQAAIRAHDTSLTGDESVPQRLATWRTKGATPFNEAFEQVRRALLTLDPEGKHEGTAPDVAGLMSAASRLGFRAGITPELYAILIEAVKLPDHSADQEFERNFGNISVNELLKVRALAQYYDISDDLCTEFIENYALKGYRQNRTNSLSRLAYPKMDQAGNLSLLHVSRSYATAQSVHYIELIPAQHSNVFEVLRFSFASVPSTAARLEVFTSVNVGGWQSIFVDEQFNAGKTDHEYQLPVSIEIPQDQQQQASVALNCYDSSGKLLLWPTAHFSLGLNLDKNVLLEINKSIRAHKATGLAPAAVDAAAASVHADWTMDETAVRRMLEMQSSMQRNAIDHDRALCLCNGDISRLRFGGQSSQFDRLFNSPPLNGYVFGTGGPRIDLKPDSQGDDLRKAVLKRAFQVDDVALYRLLLMADPGNQDGTIPNDLRHLSALYRAHLLADVHRLSVDDLALLLAGLGETATRLIGIGDEALYGLLRRLGTAVRWLNDMKWNPYDLFVMTTTVYADTLTPDIQNLLEALNNGLPDADLNDGELIEAMAPYVAASLRLTSNEVACAVLLWLDQLQPNGMGVDAFWAAVANHAPPPAAAIQFCHALAQLALVYQATGLDANSFRRLVEQPDSLVTLPEGATVAGHDARTLMQLTAYAEWVGRLAGNAATVLSAFEVDTLTPTQLAQAMALDEQLLRQAGKQAAQHEQIEDSELLHTWPEIDVVMQWINLANGLGVAPKGVADWLALDYIRPADAAVLAYPEWERVATSFVAALPADQADTVAGTVAESLAATLAGYYLAEVADPTLNLRTRDDLYSYLLIDNQVSPQIKTTRIAEAMASIQLYVHRALSRSEPQVLTAVSSRQYFADWETYNKRYSTWAGVSQLVYYPENYIDPTLRIGQTGMMNNLLQSVNQAYLTADTVDDAFNIYLTAFEQVANLDVVSAYHDNVNVDQGLTYFVGSNRSSEAEFSWRSVDHNKCHDGQFAANAWSEWRAINCALKPYHGVIRPVVRNTRLYLVWLERTERAEAKAEGEDVINEVAYQYWLKLAYLRYDGTWSAPLTYEVSTTLAKLQLADDEAPGLYCAESPTHQSLLVLFYKIQGTANAARVAGLVIQQDLSSRDLTTEQSQYYRDNVHAQFDTPNRRRVNNRYGEHYQIPYSVTVNSGFEWGAHQISRVFGGKIAGITYESSLDKLYIKCAISLGVTFDVTKSVNNMAYMQLYTMQRQFQAGDRVILYNDSTQCYGPVGKYGTSTFVVSNHVDVGPSPDPLRPYRAIQIRYTGSSINASRITYNGIGIYSFGNVPADLANSIQVQFDDYGHYVTYSYAGIQPSADLNTKIPPDKVVISCVAGGGSQHFSADAHVENLPPPSLYAMNFSFEKLTVDASRLIYVDNRASVDITCEAKFADGQLAGKEFFSIPVVRIVEGTSNVLSLHRDNNGAQYMQWEGYRVRLNTLFARQLIERAAVGLDRIMTLDTQYLAEPPLGEGGYVNVTLPAYNPTVHGSTRGVRLVLQSGAALAPAEFAFLNASLTDIAQHHMLFVPVSQVRAGDALDFPADLSTGLGVVLACQRGQFKAGQLRFDPATLKPTDFVKDSGWTSGRDADVQIDPIYIEPMDFGGANALYFWELFYYTPMLVAQRLLVEQRFDEAQRWLQYVWNPAGYVVEGLLQDYQWNVRPLEEDLGWNAESLDSTDPDAIAQVDPMHYKVATFMRWLDLLLARGDRAYRQLERDTLSEAKMWYVQALQLLGEQPYLPRAAEWSEPSLAAAADETAQLARLQALEALSAGGQPAPLTANSLTALFLPQANDVLQGYWRTLEQRLYNLRHNLSIDGQPLSLAPYATPANPKALQSAAVSASSGGKPLPPSYLTLWRFPQMLENAKSTVSQLMQFGSSLQGIIERQDAEALSELLQNQAKDLVLISLSEQDQRLAEVDSSILALTEAMEAATQRRNHYTKLYDENINSGEQAVLGLRASSSAITATATALQMAGALAEMVPNIFGFSIGGSRWGAALNASAFGAQVSAAVTMITADQLSQSEMYRRRREEWDIQAKNAQADVDQIKAQQTTLRHQWEAAMLQRDYLQRQQEQTEAQLEFLKIKSSSKALYSWMRGRLLAIYSQFSDLAVARCVMAEQAFQWETHKVDSFIKRGAWQDAYYGLLCGEELMRNLAEMEAAYLIQDARALEVVRTVSLADFYAGLPDDKQFDLAEKVVTFIEEKGGRAGSDANSLLLENGRLSATVTLRDLKLVDDYPANMQLGSLRRIKQLSVSLPALIGPYQDIQAVLSYGGSIVLPRGCEALAVSRGLDDSGQFELNFNDGRFLPFEGIPVDDVGTLTLAFPNALGKQEAMLRTLNDIVLHIRYTILR

SEQ ID NO: 7 - protein, 1197 aa, Yersinia pseudotuberculosis
MPTSTVLNKINESRRDALVNYYLAKNVSGDEEIKTAEQLYQYLLLDTEISHEVKTSPIAEAISSLQIYINRCVDGEEIELHEKNISKHFSTDNFLHNWNIYNKRYARWAGKEKLMYYAADYIDPTLRYNKTELFNTFEQSINNSKLTEKSVKSALQSYLISYEKLSQIDTIKELYVEDIKTYFFLGKTRESPCQYYWRSSEKLSNDSNNLHWSEWRKVNCNINGTEKKFFINLSWHRSGLYIDWINTFSIKANKDETTEKYHYNRVYKNDGNTWSELIINMDIGFKLRSSSEVVTLPPFFVNQGDPNSKEEVENLFLTNGTSIKKIESRIHGYINGDIKILCNEDNISFEIAEKLINGNNGTISDIKLIENGKEILIIKNEKGEKKEIKLIDKFEIKIFPYNELVASSIVFNRIKPEEKIINELENKVSLLSPNSLPLKENFQKSVDELLSYSTQKDKVGLDAFNGSYGIYIWELFFHIPLLASMRFLNEQRFDLAQHWLKYLFNSAGYRDGNGDLLKEGDNILYWNSLPLQQDTDWDKNTLTLPTDDPDVIAMQDPMQYKLAIFMRTLDLIISQGDQAYRQLERDTLAEAKIYYIQASQLLGPRPDLNHGHKWENIKLAEESHQSENGHFLPPYNEILLSYWDKLEIRLYNLRHNLNLDGQPLHLPLFATPVDPKALQRQHGAGNGINSGEQMATAQTSLYRFPLLIERAKSAVSSVIQFGNSLQSVLERQDNEAMTLLFQQQQQKVLQHTKNIQDNNILVLQASLDATSSLKSAAKQRSKHYKELLDNGISSREQSGLDLRIDAGAVNIASVAPLMLAAALDTAPNVFGLADGGSHWGAVPYATSATLQISASLTESRANINDIKANYDRREQEWTLQKNQADKDAEQLAHQYTSVQEQLNMAQKQRNLAELEQGHADALYQMQSTRFTGKELYNWMAGRLSGLYFQLFDATQPLCLMAKAALEKEVDKAKTDGLFIRSGWNDLYQGLLAGEDLQLNLQKLENVWLMEEQRALEVERTVSLAQHYQQLGDHKFDLAEIVTGYMAQDKTEKAGNEQDGVELKGGTLIVSLSINGLNLIEDYPATMHLGDIRRIKQISVSLPALLGPYQDIQATLDYAGENTHLAKGCTALAISRGMNDSGQFQLDFNDGKYLPFEGIDISDKGTLVLRFPNATGKQKLLLQSLSDIILHIRYTIRS

SEQ ID NO: 8 - protein, 1197 aa, Yersinia pestis
MPTSTVLNKINESRRDALVNYYLAKNVSGDEKIKTAEQLYQYLLLDTKIGHEVKTSPIAEAISSLQIYINRCVDGEENDLHEKNISTHFSSDNFLHGWNSYNKRYARWAGKEKLMYYAADYIDPTLRYNKTELFNTFEQSINNSRLTEKSVKSALQSYLISYEKLAQIDTIKELYVENIKTHFFLGKTRESPCQYYWRSGEQLSNDSHHLRWSEWKKVNCNINGTEEKFFINLSWHRSSLYIDWINKFSIRTDKDETTEKYHYNRVYKNDDNTWSELIINMDIGFKLSTSTEVITLPPFFVNQGDPNAKEEVENLFLTNGTSIKRIESRLHGYINGHIKILCNDDGISFEIAEKLINGDNGTIGEVKIIENEKIISTINNEKGENKKINLIDKFEIRIFPYNELVASTIVFNRIKPEEKIIDELDDKISLLSPNSLPLKEKFQTSVDELLSYNTQKNNVKLNAFNGSYGIYLWELFFHIPLLASMRFLNEQRFDLAQHWLKYLFNSAGYRDGNGNLLKEGDNILYWNILPLQQDTAWDKNTLIQATDDPDVIAMQDPMQYKLAIFMRTLDLIISQGDQAYRQLERDTLAEAKIHYIQASQLLGPRPNLNSSHQWENIKLAEESRQLENSHFLPPYNELLLSYWDKLEIRLYNLRHNLNLDGQPLHLPLFATPVDPKALQRQHGAGNGINSSEQIATAQTSLYRFPLLIERAKSAVSAVIQFGNSLQSVLERQDNEAMTLLFQQQQQKVLQHTKDIQNNNIQVLQASLEATDSLKSAAEQRRKHYKELLDNGISSDEQLAINIRIASAALNGESLVPLGLSAVLDTAPNVFGLADGGSRWGAISQAVGWGMQSMAMALETTAGVRDAKANYSRRAQEWTLQKDQADKDIEQLAHQYTSVQEQLNMAQKQLNLAELEQGHADALYQMQSTRFTGKELYNWMAGRLSGLYFQLFDATQPLCLMAKAALEKEVDKAKTDGLFIRSGWNDLYQGLLAGEDLQLNLQKLENVWLMEEQRALEVERTVSLAQHYQQLSDHKFNLAEIVTGYMAQDKDQKTGNEQDFVELKNGTLITSLSIKGLNLVEDYPETMHLGDIRRIKQISVSLPALLGPYQDVQATLDYAGENTHLAKGCTALAISRGMNDSGQFLLDFNDGKYLPFEGIDISDKGTLVLRFPNATSKQKLLLQSLSDIILHIRYTIRS

SEQ ID NO: 9 - protein, 2376 aa, Serratia entomophila
MRQDIMYNIDDILEKVNAPRARLSEENDTAVTLTDLFSRSFPEVKKITGDSLSWGEVCYLYSQAQHEQKENRLTESRILARANPLLVNAVRLGIRQAAGSRSYDDWFGSRADRFARPGSVASMFSPAAYLTELYREAKDLHPDTSLFRLDIRRPDLAALALSQNNMDDELSTLSLSNELLYRGIGAAEGLDDDSVRELLAGYRLTGLTPYHWAYEAARQAILVQDPTLMGFSRNPDVAQLMDPASMLAIEADISPELYQILAEEITTDSYEALWSKNFGDMPPSSLLSYDALATFYDLDYDELTSLLSLRLDFSNPNNEYYINSQLSVVTLNESTGLITIHHYLRTLGGDSQQINPELIPYGDGTYLYNFSVVSTISEDSFKLGSLGSNSSNLYSGDYQLQKGVRYSIPVEIDEGKLNDGITIGLSRKGGGYYSTVNFTLIEYDPAIFILKLNKVIRLYKATGMTTAEIYQITNILNNGLTIDHAVLSKIFLVRYLMRHYQLDVARSLILCNGTISDQAFSGETGLFTTLFNTPPLNGQLFSADDTPLDLRSEAPEDAFRLSVLKRAFNISASGLSTLWQLASGDSSAGFSCSADNIAALYRVKLLADIHDLSAGELSMLLSVSPFSGVAAGSLSDNELTQFLYQTTTWLTEQGWTVSDVFLMLTTQYGTLLTPDIENLLASLRNGLSGRELFPETLPGDGAPFIAAAMQLDATDTAKAMLTWADQLKPEGLTLTEFILLVMNAAPNDEQAGQMAGFCQALWQLALIIRSTGLSTRELTLLVSQPGRFRTGWHHLPHDLPALRDITRFHAVVNRSGSHAGEVLTALETGELSSALLARALSQNEQDVTGALAQVRGAGEQDNSVFTSWEEVDQAEQWLDMSETLSITPSGLASLIALKYINVSDDSAPLYSQWQVVSGLLQAGLKSSQSSALHDYLEEGTSSALCAYYLRNLAPNMVSGRDDLFGYLLLDNQVSAKVKTTRIAEAIAGIRLYINRALNGIELSAMAEVRGRQFFTDWDTFNKRYSTWAGVSELVYYPENYLDPTVRIGQTGMMDTLLQSVSQSSINRDTVEDAFKTYLTTFEQIANLNTVSGYHDNASMTQGTTWYVGRSITDQTNWYWRSANHSKIQDSMMPANAWTGWTKINCGMNPWSDLVCSVFFNSRLYVVWVEENQSADTEAESTTTTQQSYTLKLSFRRYDGTWSSPVSFDITGNIAFPETQGMHVTCNPLTEQLYCAFYSVTSKPDFDNAQLISVDNDMTLNVISDIGIFKSVSHEFNTSTEKFINNVFSDPSANYFVSATSLIDDVIHSDFSLLNSKTTSTVFTNEDSSLLTPELHITANVSCFVSTAGIATQSTIEKFVQAGIEFEEINFYAGQAAGGFDGFVGVDVSNSKVYQVGKEAVGVTVKSYSVTGVSGSVELFIDSSNKYFSGILSDKMITALISGSTSKVNYVSSIGSQDFWSVKSLMPALQIYELIDDIILTSGVNGTEIKSWPSAEWYNDKLSLQSGNNLFNTKSLSFTVNTSDIVEDEFDVTFTFTAVDQNNVVLAARTAILTVIRNINNDTSVIALRKNTRGAQYIRFTAGNDVALIRLNTLFARQLVDRANTGIDTILSMETQRLTEPALEEGSDVFMDFSGANALYFWELFYYTPMMVFQRLLQEQHFPEATRWLQYVWNPAGHVVNGVLQNYTWNVRPLEEDTGWNDSPLDSIDPDAIAQYDPMHYKVATFMSYLDLLIARGDAAYRLLERDTLNEARMWYVQALNLLGDEPYISFDADWSALTLGDAASEVTRRDYQEALLAVRRLVPAPETRTANSLTALFLPQQNEVLKGYWQTLAQRLHNLRHNLSIDGQPLSLSVYATPSEPSALQSAVVNSAQGAAALPAAVMPLYSFPVMLENARGMVSLLTGFGNTLLGITERQDAEALAKLLQTQGSELIRQGLRQQDNVLEEIDADIAALEESRRGAQMRFERYKVLYEADVNTGEKQAMDLYLSSSVLSASTAALFLAEAAADMLPNIYGLAVGGSRYGALFKATAIGIQVSSDATRISADKISQSEVYRRRREEWEIQRDSAQSDVAQIDAQLAAMAVRREGAELQKTYLETQQTQAQAQLAFLQSKFNNTALYSWLRGRLSAIYYQFYDLAVSRCLMAQQAWQWDKFETRSFIQPGAWMGANAGLLAGETLMLNLAQMEQAWLTGDERAIEVTRTVCLSEVYTSLAEDAAFSLADKVVELVSNGSGSAGTKSNGLQMDQQQLEATLKLADLGIGNDYPVSLGTMRRIKQISVTLPALVGPYQDVRAVLSYGGSMVMPRGCSALAVSHGMNDSGQFQLDFNDPRYLPFEGLPVDDTGTLTLSFPDADGKQQAMLLSLSDIILHIRYTIIS

SEQ ID NO: 10 - protein, 1205 aa, Bacillus thuringiensis
MSNSTVLQSIKESRRDVLVDHYIANNVPKDLTDKITDAESLYEYLLLDTKISDLVKTSPIAEAISSVQLYINRCIQGYEGELTTQSKSHFAPGKFLSNWDNYNKRYTTWSGKERLKYYAGSYIDPSSRYNKTNLFKNLEQSISQGRLTEESIKNALHNYLDEYETLANLEYISVNKGDGEDAESVLFFVGRTQTFPYEYYWRSLILKKNSNNILIPEKWTQWEKITANIGEAVDSYVVIYCYKKRLHVQWSSSEKKQNINKESIDIQYLNDWVMNSSGVWSAFQKSPFKSFDYIPNSITGFSKENIHIVDNKVICDDPNSIKVKVTSLPGNRVRIYFEKIYNSELSGSTLSFWPALSSDPEINEGEQKDYIIDFDSEPYYGLLVRLNFDQKEYYFSVLYYPSPYQELYGSIINDQFIPPSNSKIIEPISLTLKNNIDLANLCENSIDTLFEYTVQGELGDTIAFYGPYGIYLWEIFFYIPFLIAVRLLIEQRYELVERWYKFIFNSAGYRDENGNLLKDKNGNVRYWNVVPLQEDTEWDETLSLAITDPDEIAMADPMQYKLAIFIHTLDFLINRGDHAYRMLERDTLTEAKMYYIQAKQILGPRPEIRINNSWDNPTLQSEAGAMTAEPTRNNLDITPIMQLQAFLKSENGHFLSPYNDELLAFWDKIELRLYNLRHNLSLDGQPLNLPLFVEPMNPRDLQIQYSTGDGMGGSVASSQSSQSIYRFPIVIDKARTAVNSVIQFGSALENAFAKQDTEAMTLLLQSQQQVILQQTRDMQEKNLDSLQASLEATTIAKASAESTKTHYAGLVENWMSDNETSSLKLRSDAGIIHTSSEVAMTIAAALDMAPNVFGMAVGGSRWGAASTAVAQGLQISANVMEQTANIMDISESYRRRREDWMLQRDAAEAEESQLNLQIKALQEQINMARKQIFLSETEQAHAQAIYQLQCTRFSSQALYNWMVGRLSSLYYQMYDATLSLCFMAKNALEKELGKDKTTGMFTLPAWDDLYQGLLAGEMLMVELQKLENLWLEENKWGMEAVKTVSLDTLIRKKNPEFAFVDLVQEVLSGKIPEGVSGIEVKLQNNIFSASLDLSSLGLENSYNLKEKNRKIKNLSVTLPALLGPYQDVEATLSLGGETVTLSHGVDDSGLFITDFNDSRFLPFEGMNLLSGTLTLAIFHTGKDGDQRSLLESLNDVIFHIRYVMK

SEQ ID NO: 11 - protein, 1487 aa, Yersinia entomophaga
MQNSQEMAITTLSLPKGGGAINGMGESVGQAGPDGMVTFSIPLPFSAGRGVAPALSLSYSSGAGNGPFGMGWQCSAMSISRRTQKGVPQYNEDDEFLSPSGEVMAIALNDSGFEDVRTANRLQGIPLPFSYKVTRYQPRLIQDFIKIEYWQPVKQTDGTPFWIIYSPDGQTHILGKNSHSRVANAENPSQIASWLLEETVTPTGEHIYYQYSGENQVNCTDAEIALHPQDSAQRYLARIDYGNISPQASLFVLDEELPNLTQWLFHLVFDYGERDISINKIPTFEGGTTGWLARPDMFSRYDFGIEIRNRRLCHQVLGFHRLEALNDRDVTDEIPVLVNRLTLDYDLNNSVSTLVAVRQVAYETDGSPITQPPLEFDYQRFDTGSIPGWQEMPQLEAFNGYQPYQMIDLYGEGTPGILYQETPGAWWYKSPQRQIGGDSNAVTYGAMKALPKIPRLQEGATLMDINGDGRLDWVITSAGVRGFHSIHSTGEWTHFTPLNTLPTEYFHPKAQLADLVGAGLSDLVLIGPKSVRLYANQQGNWAPAQDVTQAENVSLPVIGIDSRQLVAFADMLGSGQQHLVEITADSVKCWPNMGHGRFGQPLTLEGFSQPQTSFNPDRVFLADIDGSGTNDIIYAHSECLEIYLNESGNRFSKPISLLLPDGVNFDNTCQLQAADIQGLGIASLVMTVPHMSPTHWRCDLALNKPWLLNVMNNNRGAETCLFYRSSAQFWLDEKQLVEAAGQQPECHLPFPMHLHWRSEIFDEITGNRLTQEQEYAHGSWDGQEREFRGFGRLIQRDTDGFAQGTVDIPTHPSRTVSWFATGIPEIDTTLSAEFWRGDDQAFSPFSPRFTRWENDSEAGSDVAFIPSEHDAFWLNRAMKGQLLRSELYGDDGTPEAEIPYSVTEMRHQVRALPTTDATVPSAWCSTIETRSYQYQRVAADPQCSQQVVIKADRYGSPLLSVAINYPRRKKPEKSPYPDDLPETLFDSSYDTQQQQLHLTKQQQNYFHLTNDDNWLLGLPKEQRNDGYQYDQERAPANGFTLETLIASNSLIGSNQPFTYLGQSRVAYQGGVDEQPSLQALVAYGETAILDEKTLQAFVGVLDSKTRDELLFSAGYQLAPRLFRVESEPDVWVARQGYSEFGDYSQFWRPLSQRSTLLTGKTTLKWDKHYCVVIETQDAAQLVTQARYDYRFLTPYSLTDANDNQHYVVLNPFGEVIASRFWGTEAGKDAGYSTPQAKPFVVPATIEAALALSPGIPVAHCAIFEPESWMQKLTQHDVSERMADNGTLWNALLQARFVTEDGYVCALGRRRWMARHGLSVLMLTLLAEIPRTPPHSLTITTDRYDSDDQQQLRQRILFSDGFGRLLQSAQRVEAGESWQRSEDSSLVVNVSGTPALVVTDNRWAVSGRTEYDGKGQGIRVYQPYFLDDWRYLSDDSARTDLFADTHIYDPLGREYQVITAKGYRRERQYTPWFVVNQDENDTAANLAI

SEQ ID NO: 12 - protein, 1506 aa, Xenorhabdus bovienii
MTQDSQDMTVTQLSLPKGGGAISGMGDAISNAGPDGMASLSVPLPISAGRGSAPNLSLNYSSGAGNGPFGIGWQSSTMAISRRTQHGVPQYHGEDTFLCPMGEVMAVAVNPSGQPDVRQTDKLLGGQLPVTYTVTRHQPRNIQHFSKLEYWQSLTDVETTPFWLMYSPDGQIHIFGKTEQAQIANPAETSQIAQWLLEETVTPTGEHIYYQYRAEDDIGCDDSEKNAHPNASAQRYLAQVNYGNITPESSLLVLKNTPPADHEWLFHLVFDYGERTQEINTVPPFKAPSNNWRIRPDRFSRFEYGFEVRTRRLCQQILMFHRLKSLTGEQIDGEETPALVARLLLSYDLNDSVATLTAIRQMAYETDATLIALPPLEFDYQRFEAKVTQKWQEMPQLAGLNAQQPYQLVDLYGEGISGILYQDRPGAWWYQAPIRQKSVEDINAVTYSPVKPLPKIPSQQDRATLMDIDGDGHLDWVITGAGIQGRHSMQPNGEWTHFIPISALPTEYFHPQAQLADLVGAGLSDLALIGPRSVRLYANDRGNWKAGINVMPPDGVNLPTFGGDASSLVAFSDMLGSGQQHLVEIAAQSVKCWPNLGHGRFGEAILLPGFSQPSGIFNANQVFLADLDGSGTADIIYAHSKYLEIYLNESGNRFSAPVRLDLPKGVMFDNTCQLQVSDIQGLGAASIVLTVPHMAPRHWRYDFTYNKPWLLNVINNNSGAETTLFYRSSAQFWLDEKSQIEESGKFAASYLPFPIHLLWRNEVLDEITGNRLTKGMSYAHGAWDGREREFCGFGRVTQIDTDEFAKGTTEKTPDENIYPSRSISWFSTGLPEVDSQLPAEYWRGDDQAFAGFTPRFTRYEKADAGQAGQDIPIKEPTETEAYWLNRAMKGQLLRSEVYGDDKTENAKIPYTVTEARCQVRLIPSNDEAAPSSWASIIENRSYHYERIVVDPSCKQQVVLNADEYGFPQAKVDIAYPRRNKPTQNPYPDSLPDTLFADSYDDQQKQLYLTKQQQSYYHLTHQDDWVLGLTDTRYSEVYHYAQTDAQSDIPKAGLTLEDLLKVDGLIGKDKTFSYLGQQRVAYVGGDAEKPTRQVRVAYTETAAFDDNALHAFDGVMTSAELTQQLLAGGYLYVPQVSDAAGSSGKVWVARQGYTEYGDASQFYRPLTQRKSLLTGKYTLSWDTHYCVVVKTEDGAGMTTQAKYDYRFLLPAQLTDINDNQHIVTFNALGQVTSSRFWGTENGKMSGYSTPENKPFTVPDTVEKAFALQPAIPVSQCNIYVPDSWMRLLPQQSLTGRLKEGETLWNVLYRAGVVTEDGLLCELACRRWLNRQTTSSMAAVTLQQILAQTPRQPPHAMTITTDRYDSDSQQQLRQSIALSDGFGRVLQSAQRHEAGKAWQRAEDGSLVVDSTGKPVVADTTTRWAVSGRTEYDGKGQTIRAYLPYYLNDWRYVSDDSARDDLYADTHFYDPLGREYQVKTAKGFWRENRFMPWFVVNEDENDTAARLTS

SEQ ID NO: 13 - protein, 1485 aa, Photorhabdus luminescens
MQDSPEVSITTLSLPKGGGAINGMGEALNAAGPDGMASLSLPLPLSTGRGTAPGLSLIYSNSAGNGPFGIGWQCGVMSISRRTQHGIPQYGNDDTFLSPQGEVMNIALNDQGQPDIRQDVKTLQGVTLPISYTVTRYQARQILDFSKIEYWQPASGQEGRAFWLISSPDGQLHILGKTAQACLANPQNDQQIAQWLLEETVTPAGEHVSYQYRAEDEAHCDDNEKTAHPNVTAQRYLVQVNYGNIKPQASLFVLDNAPPAPEEWLFHLVFDHGERDTSLHTVPTWDAGTAQWSVRPDIFSRYEYGFEVRTRRLCQQVLMFHRTALMAGEASTNDAPELVGRLILEYDKNASVTTLITIRQLSHESDGSPVTQPPLELAWQRFDLEKMPTWQRFDALDNFNSQQRYQLVDLRGEGLPGMLYQDRGAWWYKAPQRQEDGDSNAVTYDKIAPLPTLPNLQDNASLMDINGDGQLDWVVTASGIRGYHSQQPDGKWTHFTPINALPVEYFHPSIQFADLTGAGLSDLVLIGPKSVRLYANQRNGWRKGEDVPQSTGITLPVTGTDARKLVAFSDMLGSGQQHLVEIKANRVTCWPNLGHGRFGQPLTLSGFSQPENSFNPERLFLADIDGSGTTDLIYAQSGSLLIYLNQSGNQFDAPLTLALPEGVQFDNTCQLQVADIQGLGIASLILTVPHIAPHHWRCDLSLTKPWLLNVMNNNRGAHHTLHYRSSAQFWLDEKLQLTKAGKSPACYLPFPMHLLWYTEIQDEISGNRLTSEVNYSHGVWDGKEREFRGFGCIKQTDTTTFSHGTAPEQAAPSLSISWFATGMDEVDSQLATEYWQADTQAYSGFETRYTVWDHTNQTDQAFTPNETQRNWLTRALKGQLLRTELYGLDGTDKQTVPYTVSESRYQVRSIPVNKETELSAWVTAIENRSYHYERIITDPQFSQSIKLQHDIFGQSLQSVDIAWPRREKPAVNPYPPTLPETLFDSSYDDQQQLLRLVRQKNSWHHLTDGENWRLGLPNAQRRDVYTYDRSKIPTEGISLEILLKDDGLLADEKAAVYLGQQQTFYTAGQAEVTLEKPTLQALVAFQETAMMDDTSLQAYEGVIEEQELNTALTQAGYQQVARLFNTRSESPVWAARQGYTDYGDAAQFWRPQAQRNSLLTGKTTLTWDTHHCVIIQTQDAAGLTTQAHYDYRFLTPVQLTDINDNQHIVTLDALGRVTTSRFWGTEAGQAAGYSNQPFTPPDSVDKALALTGALPVAQCLVYAVDSWMPSLSLSQLSQSQEEAEALWAQLRAAHMITEDGKVCALSGKRGTSHQNLTIQLISLLASIPRLPPHVLGITTDRYDSDPQQQHQQTVSFSDGFGRLLQSSARHESGDAWQRKEDGGLVVDANGVLVSAPTDTRWAVSGRTEYDDKGQPVRTYQPYFLNDWRYVSDDSARDDLFADTHLYDPLGREYKVITAKKYLREKLYTPWFIVSEDENDTASRTP

SEQ ID NO: 14 - protein, 1485 aa, Burkholderia pseudomallei
MRTPEEPSGLRQGPLSLPSGGGSIRGMGQTLSAIGPDGMAEMSLPLPMSAGRGYAPALGLTYSSGAGNGPFGIGWQMGTMSIRRRTSHGTPRYDSTDSFLGPDGEVLLVASDTEGQPDVRSANALQGVILDTRHTITRYQPRTERNFSKIEHWQPSDDTGAGFWLIRSADGQVHILGKTAQARISAPGNSTHVAQWLLEESMSAGGEHVYYEYYAEDDVGCSAAEKHAHPDTSAQRYLAIVHYGNIHPSDCLFVLSDTAPSSAGWLFVLVFDYGERAASIDAVPKFASSQPWLSRTDPFSRYEFGFEVRTRRLCRQVLAFHRLQTLAGVANGDDVPALVHRMVLQYDENPVVSMLVACRVLGHELDGRPVPMPPLEIDYQRFTPTAIWQPMRELENFDLPQRWQLVDLFGDGLAGVLYKDDHAWCYCAPQRQEGGAPDAITWRKSHMLPQIPVLNGMDTATLIDVNGDGRLEWLVTHPGLQGYHRVLPEGKWTHFTPLTALPVEYFHPRAQLADLMGAGFSDLVLIGPKSVRLYANERDGWTQGQTVIQSDGITLPIPGADACKLVAFSDVLGSGQPHLVEISADGVTCWPNLGLGRLGVPLKLPGFNQPTETFDPGRVFLADLDGSGAVDLIYAHSDHLQIYTNQSGNGFAAPQSLSLPDGARFDDTCLLQAADIQGLGVVSLVLTIPHPTPHHWRCDLSRNKPWLMSDVCNNMGAHTTLYYRSSVQFWLDEKAAANVDTPPVTNLPFPIHTLCRKELLDEITGNRLVTNMRFAHGVWDGNEREFRGFGRVEQFDTDMRACGDVSQRTAPSLTRSWFATGMPTVDERLADEFWHGDAQAFAGFSPRFTIWDTASGHDEPLTPSESARYWLSRAMKGQLLRSEVYGLDETGSEGIPYTVTESRLQLRLIASAETEQPAAWPSVVEIRSYQYERIGSDPQCSQQVQLALDAFGFPLQSVAIAYPRRPKPVDNPYPETLPDALLDNSYDAQQASVTLVRRTTRYHHLTSGETWRLGLPDCERSDVFTYESTRVPADGFSLEKLSGSESLIGAGRPFAFAGQQQVHYTMCQSEEPIAFPTSQALVAFTETAMLDDAALLAYDGVVAPEDLGPLLLECGYLRVPRLLGDGAENAVWAARRGYTDYGGAQQFWRPLRQRASLLTGVTTLTWDPHYCVVAGTRDAAGLTMQAAFDWRFLLPFKVTDSNNNQHHGALDALGRLVSRRFWGTEGGLPAGYSAPEDAPFTAPSSVDEALALTPGIPVAECFVIVPDSWMPNLSESQVSELDGEDASLWRDLRIAGVVSEDNRVCALARRRWKQQGTALDSWLAQAQRVPPHTLTLTTDRYDTDLAQQLRQQVTFSDGFGRVLQSSVRHEAGDAWQLAEDGSLVTGATGVPITAYSDFRWAVTGRVEYDNKGQVMRVYQPYFLNDWRYVRDDHARADAFADRQDYDPMGRLIRVVTAKGYLRRTQYYPWFVVKEDENDTEALEQR

SEQ ID NO: 15 - protein, 2417 aa, Burkholderia pseudomallei
MSPLPTTTPTPPLQVVTAAFPKGGGALPGLGQTLSPSGMSGAAQLSIALPLPPVRLAPALALTYHSQQGNGPFGLGVALTLPTLARQTSRGTPSYADGRDVFVFEGDELVPDAAGPTEVDNERLTRYHMRHEGRFDYLELHQPLTPADAPAPAWWRVWRADGRCEVFGRCAAARTAVPGNPAQVLEWHLEETVSPHGEHVYYSYAPREAEAARTQLACLKQVRFGNVRADPAPWSTAQGFDPATERWLFALVFDYGEHADTPQGPAWAASRPWRRRADPFSRFDGGFELRCERLCQRIVLFHQLAALGAEPVAVRALQLSHTETAYLTQLTGVRQHGYRQTGGALEQAALPPLALEYTRFDLGRADFRALEAGLVGLNAGFYQVVDLYGEGVPGILYNDGQSYRYRRAKNVKRGDQGLDVEYEAAQSLSVPGGEMSAAALMDITGDGILDAVRTEPGMAGFFTRDGDKGWQRFIPFAAFPSEFLHPRALLADLSGDGLADLALIGPSSVRLFVNRGHDGFAPPRQIDHLGPDRLPVPPGGGQTLTAFADVLGSGQPHLVRVRHNEVTCWPNLGQGRFGAPRTLRLRLDPAITAANFDPARVWLADLDGSGAADLLYLDHRTLYVHRNQCGNRFARAQTLSLPAALQYTDLHQVSVADLYGNGTSVLIISRLHPQPAHWVCDFSRGLKPYLLAGLNDNMGAQTRLTYASSAHEWLDERRADSQARCRLPFPVSVLKRLEQVDEINHNTLEQTLQYRQGYYDGEERQFRGFGLILSTDMPSPLGAAQRDAAGTPYIPALQTRTWYYTGDPDSPGAVDGNVGGSSYNGDPLAAALSPLRIERRDGQAIPLPPGTPERRVLLRALRGRVRREEVYGLNPTTGQPQATPFRVMSLRYCVREWQPATASGVPAVLLAFVLESLDYNYDQVSTDPQWQQTVALAVDTYGMVTKTVSLHYPRRAQVMPPIMPLPEAAHCSDAQQDTFLVTETRIRVTHLQEPKPNRAGWRLGLPVENRDEMLGRVAPPTSANRVYSYEELTKADGPLASATRTLARWQQQIYADPSTGDPLPLAQATREGLVCQVRTAALSQAELRRSFEGLIPSQQLEPLLTQLEDELVNQAGFVQGTAEDDKDYFWNPGLTATFADLAGFYTVRYHTDPFGNRTTYERDALTLAPTLLSNARFTAAWIDYDPWSLLPAQITDANGTVHEVSYDPFGRVHLSALKGSERAFTDSLGEARVGFGPLAGYRSSVKTVEAALRDPTGALGNAAQAYFHADHSWMGALTEAGLRAAGLPDSEVQAVWQILLQQRLITVEGYVQARLHQLAKAGTPVPGLSDTQSAAVHRAVAAVSRVPVHAATLSAERYRDEHADDPVPRPTDPVIRIALAYVDGFGRPLQGKIKAEGGLSAIVEDDGKLKLDTSGRPLQERSEERWLTQGHVVYNAKGLPRQQYQPYYLNRPVHLTDPKLDQLSASDTLYYDAPGRLAQLTKADGNRRTSQYRPWYRIETDEMGAPVATVHDGRGLAVRTVQRPPPGAATADKVRITRHAYDAAGRLVSSSDPRFFDRQQAGETTLAGNERYRYGLSGSAVTRESRDAGWQVDLLDAGGALWRSYTARDHQWRREYDALRRLSAVWLASGMSRTERCTERLRYGDDAGIDAVTARRANLRGRLVSHYDPAGLREITSYSLGGMIREEQRRFLQQRDWSSDWPATPGAAAAHLEEQIETSRWQCTALGDELMLLDAAGHRHRCAWHVSGRPSGSWLQLSGGAEQAVVSELSYTADHQLLHEQAGNGVTSDFEYDPQTRRLSRAQTTRTASGRAATVLQDLRYTYDRVGNVTQLADQATRVRYFRNQRVAAVRTYQYDWLYQLVRATGREQANAGQEGVALPPVGNPDALVNYTRTFAYDAAGNLTRTVHRGATRYVLALAVSRSSNRAVAGRRVGADDVEAQFDAQGNPHRLGSNQPLTWSADNRLSRAVQLPRTGGEDDSEAYGYGGDGQRVRKWSSQQAGAVTHRREVRYLPGLERRTNTATGEVLEVVSSAVAGRTAMRCLHWRASRPGGLDNDMRRYSVNDHLGSSGLELDQSGQRLSAEEYYPYGGTAVWLPKSQVEGNYKFVRHAGKERDVSGLYDYGYRHYAPWLARWLNPDPAGTVDGLNLYRMVRNNPVTFIDRDGIAATRLNWLDLAPAPSPAAVAVASRKLDSRHTSFPPTTGLIQNVKVKNEALIGQVLASHLEASRGLSAPIEAKKFPQLELPPDMIFRLGRIDEDSYLLFPTAAGKVQKIPYGTLSYVIRYEDPLSIYVFEHSELAERKDLTEKVIPRLANYGHSSLTYKEDKPNMFDRSIPKAERFRQSAKPVLLAGNLNFEMAEYPQLGAGRLISWSVESGHFQPTDKDAVKNRIGFIQQLLPIGKFNRIDWEEKRKQIQRP

SEQ ID NO: 16 - protein, 1505 aa, Yersinia pseudotuberculosis
MENSKQQVAVAPLSLPKGGGAITGMGDSLGAIGPSGMATLTLPLPISAGRGYAPPLALNYSSGNGNGPFGLGWQLNTMAICRRTSKRVPHYDEHDEFLAPSGEVLVVAIDQQGNIERTEQSLKGEQFSVIRYLPRIEGSFNRIEYWQPRVDNSQAPFWVVHGSDGQKHCLGYSASARIADPQHPEHIAEWLLEESVSLSGEHICYLYQAEDEQGIDEDEKQNHPAASAQRYLSTVVYGNREVAHELYCLTQQPTEKSWLFSLIFDHGEYSNIADQVPIAEEGKSWTYRQDAFSHFNYGFEIRTRRLCQQVLMYHNLSALAGNEPDQQPTLVSRLRLNYQHDVYATQLVGCQRLAHEPKGKTCSLPPLEFDYQTFPDNNEKPYWQQRLEEINPTESDDQDLSANWQPLEDWAEFNHQYQMVDLNGEGIPGMLYQDRGHWCYRPPVRQPGTLNGITFGPAQSLPTLPAMGENATLMDINGDGKLDWVISQPGLAGYFSRDPDQSWTQFTPLSALPAEYFHPQAQLADLIGSGLSDLALIGPKSVRLYANQRDGFAAATQVTQDDDITLPLSGAHYSELVAFSDVMGSGQQHLVRVRHNSVTCWPNLGHGRFGHPISLPGFSQPIEQFNPLAIHLADIDGSGTVDLIYATAHQLLIYRNQSGNRFAKPLEVTLPAGVRFDNSCQLSLADIQGLGVASIILSVPHPAPQHWRYDFVASKPYLLCTTNNNMGAESQLFYRSSVQFWLDEKAQAAKQGRTLVCQLPFPIHLLAQTTQFDEITGNSLSQTARYFHGFYDGIQREFCGFGRVDTLDTNTSAQGSAAERTSPTQTCQWFHTGQPGNEQLWHHEYWQGDSQAYGLLSTRLTKFTGEMQGDETLNDINDNQAYWLHRALKGSLLRSELYGLDGSELATQPYSVNSARYQVRQIQSSTDEITSPVALPMMLEQLNYHYERIVQDPQCNQQIVLRCDEFGHPLHSATIYYPRRDKASIPPYSWLAEGHWDSHFDEQQQQLRITESQQSYRHEISDKFYVLGLPAGQRSDVLTYPDNFVPTAGIHWEELQQPEGLLGTKAERTFAGQQQVFYASDTIPGLVAYSQQAEFDDQTLAALDELLPTNERKQQLIEAGYQRAPRLFSRPGETDIWAAQRGFTDYGDASRFYRPISQRSSPLVGKTALEWDKNSCAITQMILADGSTTQAEYDYRFITPYHLTDINDNSRHIELDALGRVTSSRFWGTELDSQTGEVSTTGFPLIAEHPFTVPNSVDAAISMENTQVPVAQFSVYQPQSWMISLQLDDIETLSETNNVTLEYLFQNHILIDNYYLCPLALRRWIRQSNPLITENVGLELKNPVRQPPHVLTVVVDNYFSAAEPQQHQQTLAFSDGFGRVLQSAQRVEAGTAYFHTGEGGLIADQQGHLMQDESDQRWAVSGRTEYDNKGLPIRRYQPYFLDDWRYIADDNARKEAWADTHIYDPLGREIKVITAKGYLRRAHYFPWFVISEDENDTASEITPNP

SEQ ID NO: 17 - protein, 1516 aa, Yersinia pestis
MITPLPQSTGPTEGLIGEPFMENSKQQVAVAPLSLPKGGGAITGMGDSLGPIGPSGMATLTLPLPISAGRGYAPSLTLSYSSGSGNGPFGLGWQLGTMAIRRRTNAQVPRYDEYDEFLAPNGEVMVVAADPQGSIERTEQSLNGEQFSVIRYLPRIEGNFHRIEYWRPRTNNSQAPFWLVHSSDGQKHCLGYSAAARIADPLHPEHIAEWLLEESVSLSGEHIGYQYQAEDEQGIDEPSIYKAEKQNHPAASAQRYLKRVVYGNRQAAYELYCLTQQPAPTSWLFSLIFDHGEYSNIAEQVPVIIKGKSWNFRQDAFSHFNYGFEVRTRRLCQQVLMYHNLSALKGDEPDAQATLVSRLRLHYQHDAYATQLVGCQQLAHEPDGTKRSLPPLEFDYQDFSTRDALGWQPLTDWAEFNYQYQMVDLNGEGMPGMLYQDSGHWIYRPPVRQPGTADGITFGAAQRLPSLPAMRENAMLMDINGDGKLDWVISQPGLAGYFSRDPDLSRDPDLSWTQFIPLSTLPAEYFHPQAQLVDLAGSGLSDLALVGPKSVRVYTNLCDSFAAATQVAQDDDITLPLPGVHFTELVAFSDVMGSGQQHLVRIRHNSVTCWPNLGHGRFGHPLSLPGFNQPVEQFNPLAIYLADIDGSGTIDLIYATTSQLLIYRNQSGNRFAEPLAIALPTGIRFDNSCQLSLADIQGLGVASIMLSVPHPTTQHWRYDFVASKPYLLCTTNNNMGAESQLLYRSSVQFWLDEKAQAAKQGRSLACQLPFPIHLLAQTTQFDEITGNSLSQTARYFHGFYDGVQREFSGFGRVDTLDTDTSAQGSAAERTAPTKSSRWFHTGRAGNETLWQSEYWQGDDQAYSLLPTRLTKFINNTQGDELLSELDDNQTFWLHRALKGSLLRSELYGLDDSELATQPYSVNSSRYQVRQIQSSADGISSPVALPMVLEQLSYHYERIAQDPQCSQQIVLRCNEYGHPLHSVTINYPRRDKARISPYSWLAKEHWDSHFDEQQQQLRITESQQSYHHEISDKFYVLGLPAGQRSDVLTYPDNFVPTAGIHWEELQQPEGLLGTKAERTFTAQQQVFYTSDTIPGLVAYSQQAEFDDQTLVALDELLPANERKQQLIKAGYQIAPRLFARTGETDIWVAQSGFTDYGDASRFYRPISQRSTQLVGKTILEWDATCCAVSDIILADYSITHAEYDYRFITPYLLIDINDNQHYIELDALGRVTSSRFAGTEIDPQTNKVIETGFPSIAEQPFSAPNSVDKALSLENTRIPVAQFSVYQPQSWMISLQLDDIEIWIRANNITPEYLFQNHILIDNYYLCPLALRRWGRQNNLLITEGVGLTLKNPMRQPPHILTVVVDNYFSASEPQQHQQTLAFSDGFGRVLLSARRVETGPSYSFDPENGLLVDDKGNLVQLEVDQRWAVSGRTEYDNKGLPRRRYQPYFFDNWIWLYIANNRTLKEAYADTHIYDPLGREIKVITAKGYLRRTHYFPWFVISEDENDTASEITPNP

SEQ ID NO: 18 - protein, 1428 aa, Serratia entomophila
MQNHQDMAITAPTLPSGGGAVTGLKGDIAAAGPDGAATLSIPLPVSPGRGYAPTGALNYHSRSGNGPFGIGWGIGGAAVQRRTRNGAPTYDDTDEFTGPDGEVLVPALTAAGTQEARQATSLLGINPGGSFNVQVYRSRTEGSLSRLERWLPADETETEFWVLYTPDGQVALLGRNAQARISNPTAPTQTAVWLMESSVSLTGEQMYYQYRAEDDDGCDEAERDAHPQAGAQRYPVAVWYGNRQAARTLPALVSTPSMDSWLFILVFDYGERSSVLSEAPAWQTPGSGEWLCRQDCFSGYEFGFNLRTRRLCRQVLMFHYLGVLAGSSGANDAPALISRLLLDYRESPSLSLLENVHQVAYESDGTSCALPALALGWQTFTPPTLSAWQTRDDMGKLSLLQPYQLVDLNGEGVVGILYQDSGAWWYREPVRQSGDDPDAVTWGAAAALPTMPALHNSGILADLNGDGRLEWVVTAPGVAGMYDRTPGRDWLHFTPLSALPVEYAHPKAVLADILGAGLTDMVLIGPRSVRLYSGKNDGWNKGETVQQTERLTLPVPGVDPRTLVAFSDMAGSGQQHLTEVRANGVRYWPNLGHGRFGQPVNIPGFSQSVTTFNPDQILLADTDGSGTTDLIYAMSDRLVIYFNQSGNYFAEPHTLLLPKGVRYDRTCSLQVADIQGLGVPSLLLTVPHVAPHHWVCHLSADKPWLLNGMNNNMGARHALHYRSSVQFWLDEKAEALAAGSSPACYLPFTLHTLWRSVVQDEITGNRLVSDVLYRHGVWDGQEREFRGFGFVEIRDTDTLASQGTATELSMPSVSRNWYATGVPAVDERLPETYWQNDAAAFADFATRFTVGSGEDEQTYTPDDSKTFWLQRALKGILLRSELYGADGSSQADIPYSVTESRPQVRLVEANGDYPVVWPMGAESRTSVYERYHNDPQCQQQAVLLSDEYGFPLRQVSVNYPRRPPSADNPYPASLPATLFANSYDEQQQILRLGLQQSSAHHLVSLSEGHWLLGLAEASRDDVFTYSADNVPEGGLTLEHLLAPESLVSDSQVGTLAGQQQVWYLDSQDVATVAAPPLPPKVAFIETAVLDEGMVSSLAAYIVDEHLEQAGYRQSGYLFPRGREAEQALWTQCQGYVTYAGAEHFWLPLSFRDSMLTGPVTVTRDAYDCVITQWQDAAGIVTTADYDWRFLTPVRVTDPNDNLQSVTLDALGRVTTLRFWGTENGIATGYSDATLSVPDGAAAALALTAPLPVAQCLVYVTDSWGDDDNEKMPPHVVVLATDRYDSDTGQQVRQQVTFSDGFGRELQSATRQAEGNAWQRGRDGKLVTASDGLPVTVATNFRWAVTGRAEYDNKGLPVRVYQPYFLDSWQYVSDDSARQDLYADTHFYDPTAREWQVITAKGERRQVLYTPWFVVSEDENDTVGLNDAS

SEQ ID NO: 19 - protein, 1458 aa, Bacillus thuringiensis
MSQTNTNVGLFSPSLPKGGGSIKGMEGSVTAPGSDGMARFNVPLPVTPGRTITPDVNLSYSSGNGNGPFGMGWHMGFMSIRRRTNTGIPSYKSGDHFIGPDGEVLVPESDENGQVITRQTDTTAQGISLGEPFIVTRYFPRIESNFNLIEYWEAKEDSHTSPFWLIHSADGILHCFGKTVQAKIASPDDPTKIAEWLLEESVSPFGEHVYYQYKEEDNIGINLKQDTHQYGGNRYLKTIRYGNKVAYHSLYLWNGEIPMDSQWLYFVMLDYGENDTSVNGSPQYTYQGEWLARADCFSRYEYGFETRTCRLCRQVLMFHNFTELNEEPTLIWKMQFEYDENPAVSMLTAVQQLAYETDGKPLSMPPLEFDYTPFEIHQPIDWQPFLPAPELNNGEQYQIVDLYGEGIPGLLYRDKSHWHYRSPVRSDTLDGITYESWKSLPQIPVNVQNGMLLDMNGDGYLEWLIAQSGVIGSYTMNPDKTWSNFVPFKALPTEFFHPKAQLSNVTGSGLPDLVMIGPKSVRFYAGEESGFKRSREVWQKAGITLPIEGLNEKELIAFSDMLGSGQSHLVRIRHDGVTCWPNMGQGIFGEPLVLPGFTINERDFDPKRVYLADLDGSGTSDVIYASHDALHIYQNLSGNSFADPVQIPLPAGVHFDNLCRLQPADISGRGISNLVLNVPYISPRSWYLDLCSIKPYLLKSTSNNLGASNEFFYRSSAQYWLDEKQSDSSVVCTLPFPINVISCIQTLDEISGSTKIQEYTYRNGVYDRMEKEFAGFGYIVTKVEERDYEGSISKNTQPILTRSWYHTGQQEDDTRTFTQSWKGDPIAFHLKPSRFTTFDLNVTKDVPLDSLNERQEYWLYRSLKGMPLRTEIFRGDMLESSPYLVESYRYQVRLVQSTDSECVVLPLQLEQLTYNYEQISSDPQCTQQIQQFFDEYGSSTQSVTIHYPRREQPNENPYPDTLPDTSWSSSYDSQQMLLRFTRQREKAYHLTNSENWRLGIPHQNRLDAFVYPAESVPNEGISTELLGDDGTLQTPAQEQAYGGQTEVIYVGDNKPDLRALIYYTRSAVLDEVCLQAYEGILSDEQLNLLLTSAGYKQSTRILGFEDEPDVLVAEQGFTRYTNKEGFYRMVGQQASMLTGEQVLSWDDNWCVVISAEDAVKNKTQIAYDYRFLQANQIIDANNNVSQVQLDALGRVIYSRIWGTEKGEDVGFNPALQFSSPETIDQALTLVPPLPVGSCYVYDTNSWMGKISFEQLSELVSDGTELWNFLIANRFITLDGRIRTRGRFQKDLSQLSQTVSNIFKGAIRNPSHTLILKADRYPDDPAQQIQTTIIFSDGFGRMLQSSQKAEPKGDILDNAKENLIKSENKTRWIISERADYDGKGTVIRNFQPIYLHDWQYVNNESIHSQMYATNYYYDALSRQIRVVNAKGYEQRNAFYPWFTVNEDENDTWNNGGMEE

SEQ ID NO: 20 - protein, 974 aa, Yersinia entomophaga
MNQFDSALHQGTPGVSVLDNRGHVIRELRYYRHPDTPQEIAERIAFHQYDSYGFISQSIDPRLAERRKQDSSVKPNLSYFTALSGEVLRTDGVDAGTIFSLNDIAARPAISISATGVSHTWQYEGENRPGRVLSRSEREKDREERIIERFYWAGSDASQKANNLAGQCLRHYNSAGLNQTLSIALTGTPISACFQPLLESAEPEWQGTNESAWLELLTPEIFTTYNRADANGETLVQTDAMGNIQRLAYDVAGFLKSSWLSLKGGQEQIIVKSLTYSAAGQKLQEEHGNGVLTTYSYEAETQRLIGIRTERPAGHLSGARVFQDLRYTYDPVGNVLRITNDAEATRFWRNQKVVPENTYIYDTLYQLVSANGREMANIPQQSSQLPTLSPIDNNAYTNYIRNYHYDSAGNLMQIRHTSAAANNSYTTNITVSKYSNRAVLSSLTDDVDKVEAFFDAAGRQNQLLPGQTLSWNARGELAKVTPVARDGQESDSETYRYDANSQRVSKMAIQQSNNNTQTRRVLYLAGLERRTIHQGNTLFETLLVVKIGEAGRAQVQAMHWELGQPTEVANDELRYSYDNLIGSSGLEVDGTGQLISQEEYYPYGGTAVWMARSQREASDKAYGYSGKERDATGLYYYGFRYYQPWAGRWLSADPAGTIDGLNLFRMVRNNPIVLHDPDGLAPGFFERISSFRKKDTLTISSLKGTGPFYTRSESEIDIDFLFSRQDRDKDFPPQNHKELSAEDRREVLEVSSGENITSANKSSKWYAGTHWETKPLKNNTDLVVLHNGVQGAAGININLNDIKPGRSVLVTAGTLTGCTMITGVKGNNFYALHAGTGTPSENWVTGEHGVTDNFRMLNKLIPDAGIDLNPEAVNDSLLTILDYFDNGTIAYNGKKGSEIHRDADNILNYRTTGYENTVGVSFSLLTKDKNGEVSASTLLELGELKPHKKHRTRGQFGMTELKYEARKNTVVKLR

SEQ ID NO: 21 - protein, 970 aa, Yersinia entomophaga
MDIQLFSKTPSVTVFDNRGLSVRDIAYRRHPDTPKVTEECITYHQFDFRGFLAQSLDPRLNHKEVTNFSYLTDLNGNIIYTQSVDAGNTLVLNDTEGRSVIAMTNISRGENGKDDLSLAVTRTFQYENAPLPGRPLSVTEQVNGENARITEHFVYAGNTPQEKNLNLAGQCVSYYDAAGLIQTDSVSLTGKPLSVSRKLLKNLDDTNILADWQGNDTSAWNSLLATEIYTTVTRTDAAGAVLTTIDAVGNQQRVAFDIAGQLSASWLTLKGGQEQVIIKVLTYSAAGQKLREEGGNGVVTTYTYEAETQRLIGIKTERPNGHAAGAKVLQDLRYEYDPVGNVLSITNDAEETRFWRNQKVVPENAYRYDSLYQLVSASGREVAGAGQQGSDLPSPLVPLPSDSSVYTNYTRTYTYDSAGNLMRIRHSAPATNNNYTLNITVSERSNRGVMSSLTENPADVDALFTASGSQKCLQQGQSLIWTPRGELRTVLLVARGETADDSESYRYDGSSQRILKISSQQTNHSARVQRALYLPGLEWRTMTGGVAEAENLQVICIGEAGRAQVRVLHWESGKPDGIINDQIRWSYDNLTCSSGLEVDGDGLVISMEEYYPYGGTAVWAARSHIETAYKTVRYSGKERDATGLYYYGFRYYQPWAGRWLSADPAGTVDGLNLYRMVRNNPLRLTDPDGMAPLDWLDLDTTNASRDIVKAIYQLNQIDGPHRGVRDTYQRMTESTGMILQETLNNEAVLKGIKQKDKEKKSRGMKFTNSKLKTYAAHAGVLNTLQPDPVYKDGFLNLPGSLGNKNTFPGVELIEDKVKPSLSQYHPDKLGKSQRWKPESSLGYYRVADTEAFITGIRSQYKSSGTDLHAVVEGRIRDHLLANNNVLPKMAGIAGLHAEVQALNYIISNPDIEGGNAERLNGSYIFTQRLVGDVNQDFPACYNCSGIISGLENVMTGRVNNDVRLKRRKSF

SEQ ID NO: 22 - protein, 932 aa, Xenorhabdus bovienii
MTVNRGDNLHQKTPEVTVLDNRGLTVRELRYHRHPNTPITTDERITRHRFTLAGQLAHSIDPRLFDLQQADNTINPNMVYETALTGEVVRIRSVDAGNTLMLNDITGRPVLAINATGVTRTWQYEDDTLPGRPLSITEQPADEVARITERFVWAGNSEAEKNSNLAGQCVRHYDTAGLNQTDSIALNGIPLSVTRRLLPDGTDADWQGNNESAWNDRLAPESFTTLSTADATGAVLTTTDAAGNLQRLAYDVAGLLTGSWLRLAGGTEQVIVKSLAYSAAGQKLREAHGNGVVTTYTYEPETQRLVGIKTERPPGHAQGAKVLQDLRYEYDPVGNVVKVANDAEVTRFWRNQKVVPENTYTYDSLYQLVSATGREMANIGQQSSLLPPPSLIDSSTYSNYSRTYNYDRGDNLTQIRHSAPANDNSYTTKMTVSDRSNRAVLSTLTENPAEVDALFTTGGQQNQLLPGQSLVWTPRGELLKVAPVVRDGQVSDQESYRYDADSQRIIKTHVQQTANSSQTQSTLYLSGLERHTTTNGTTVKEVLHVITIGEAGRAQVRVLHWKNGKPDSISNDQIRYSYDNLIGSSGLEVDGDGQIISMEEYYPYGGTAVWTARNQTEAGYKTVRYSGKERDATGLYYYGYRYYQPWAGRWLSADPAGTVDGLNLFRMVRNNPVSGYDNVGLVWTPVTKAVGSGILGAATLGYEAYKHSKSKNEPVQLSSNTLGNNKIHEFHKAVTDKNNKFSVTEEVKENLSGRGKVIKNFLTKGEVPAHDSIMNQKENLITIAKYSQNGDVSKLDKGKLAIASVSDASNNLPIRIYQAYKGFRTATSVTPEGVDEVMESVATAKDNVKSTLNVGIGVGVIGNSLLSVAKVFVPGAAIPITAGQALWAVSSVGKTVNQVNKAVKENIEKSPISHEFKEELFRQMGKPTNKDG

SEQ ID NO: 23 - protein, 1043 aa, Photorhabdus luminescens
MSPSETTLYTQTPTVSVLDNRGLSIRDIGFHRIVIGGDTDTRVTRHQYDARGHLNYSIDPRLYDAKQADNSVKPNFVWQHDLAGHALRTESVDAGRTVALNDIEGRSVMTMNATGVRQTRRYEGNTLPGRLLSVSEQVFNQESAKVTERFIWAGNTTSEKEYNLSGLCIRHYDTAGVTRLMSQSLAGAMLSQSHQLLAEGQEANWSGDDETVWQGMLASEVYTTQSTTNAIGALLTQTDAKGNIQRLAYDIAGQLKGSWLTVKGQSEQVIVKSLSWSAAGHKLREEHGNGVVTEYSYEPETQRLIGITTRRAEGSQSGARVLQDLRYKYDPVGNVISIHNDAEATRFWRNQKVEPENRYVYDSLYQLMSATGREMANIGQQSNQLPSPVIPVPTDDSTYTNYLRTYTYDRGGNLVQIRHSSPATQNSYTTDITVSSRSNRAVLSTLTTDPTRVDALFDSGGHQKMLIPGQNLDWNIRGELQRVTPVSRENSSDSEWYRYSSDGMRLLKVSEQQTGNSTQVQRVTYLPGLELRTTGVADKTTEDLQVITVGEAGRAQVRVLHWESGKPTDIDNNQVRYSYDNLLGSSQLELDSEGQILSQEEYYPYGGTAIWAARNQTEASYKFIRYSGKERDATGLYYYGYRYYQPWVGRWLSADPAGTVDGLNLYRMVRNNPITLTDHDGLAPSPNRNRNTFWFASFLFRKPDEGMSASMRRGQKIGRAIAGGIAIGGLAATIAATAGAAIPVILGVAAVGAGIGALMGYNVGSLLEKGGALLARLVQGKSTLVQSAAGAAAGASSAAAYGARAQGVGVASAAGAVTGAVGSWINNADRGIGGAIGAGSAVGTIDTMLGTASTLTHEVGAAAGGAAGGMITGTQGSTRAGIHAGIGTYYGSWIGFGLDVASNPAGHLANYAVGYAAGLGAEMAVNRIMGGGFLSRLLGRVVSPYAAGLARQLVHFSVARPVFEPIFSVLGGLVGGIGTGLHRVMGRESWISRALSAAGSGIDHVAGMIGNQIRGRVLTTTGIANAIDYGTSAVGAARRVFSL

SEQ ID NO: 24 - protein, 952 aa, Burkholderia pseudomallei
MFSTPDMSLHAGTPSMTVMDARALVVRRIACHRAVAGEAPDLRITRQYYDVLGRLRHSYDPRLGEMAPLPVPNFIKYHDLSGAVLRAESVDAGCSALLLDIEGRPVYMMSATGMIRRYQYEAPDLPGRLLAVSEQAPGAVTRVIERYHWAGTSAPEQDENLAGQCIRHYDTAGVIELQRCSLHGATLTLSRRLLRDAWEVNWSGEDESVWLPALENMRYGSCSTVDATAMRITHIDARGNVQRWGYDVAGQIKGAWVQLAGQEERVILASLSYSAAGQKLCEVHGNGVITEYRYEPETQRLVGMRSARASGHAAGARVLLDLRYTYDPVGNVLSERNEAQPVLFWRNQRVEPENTYRYDSLYQLIEASGRELAQRGQQGSALPRPVTPLPAHLGVYSNYRRTYRYDHAGNLVQIRHSDPATNNSYTTDITVSRRSNRAVLAQEGLLPEAVDTCFDAGGHQLVLLPGQALTWNGRGELEQVVPVSREGGDDREWYSYGGDGMRVQKVNERKASGSTRQQRVVYLPELEVHRTLNGASLCEALQVLTVSQSGQVQARLLHWETGRPAGLDNDGVRYSYGNQLGSSMLELDDAGELISQEEYYPYGGTSIWCARSQMEADYKAIRYSGKERDATGLYYYGFRYYQPWVGRWLSADPAGPVDGLNLFCMVGNNPITYTDMEGNARYVFPAFADDDLIMMLAAHNAQRRLVAKQGDVPVFLTEKERIRFMRKLEGFIVNSNKFKELFDFGKRHIDEVGYDVTPESFDRLNLRKISTQMTDLEKIREGSLSVSLYDSLVNIYIEGKSEERDRVFQNIQGGDKLYVLGHGKADYAGLEGAAEGGKALTFKKLARNFRKANLPDVNMKIALFSCESGNFGISEIDREEGAGVKPKFITPAQALLNELKDKGYRNLMTVGYRGNVMNLGFFRDPTYHHQQVLGEGNARVFTRSSQSKKVFH

SEQ ID NO: 25 - protein, 994 aa, Yersinia pseudotuberculosis
MRTSLFSKTPSVTVLDNRGLTVRDIAYHRHPDSPDVTSERITHHQYDARGFLTQSADPRLHGAGLMNFSYLTDLTGRILRTQGADNGTTVSLNDATGRPFISASNISTSDDGTEDRGQAMTRTWQYEEASLPGRLVSVTEQVTGKATRITERFVYAANTDAEKSLNLAGACVSHYDTAGLVQPDSIALTGVPLSVTRRLMKSADNPDAVADWQGADASAWNDQLDGETHTTLTTADATGAVLTTTDAKGNLQRMAYDVAGLLSGSWLTLKDGTEQVIVKSLTYSAAGQKLREEHGNGVVTTYEYEPETQRLVGIKTERPAGHASGAKVLQDLRYEYDPVGNVLKVTNDAEETRFWRNQKVVPENTYTYDSLYQLVSATGREMANAGQQSCSLPSTTVPLPADSSAYTRYSRTYTYDEAGNLTQIRHNAPATNNSYTTKITVSDRSNRGVLSTLTENAADVDALFTAGGQQTQLQPGQHLIWTARNELLKVTPVVRDGSTDDSESYRYDAASQRILKVSRQKTNTSMQTQRVLYLPGLELRSKKSGDTETEGLQVITVGEAGRAQVRVLHWESGRPDEITDDQIRYSYDNLAGSCSLELGGDGNIISAEEYYPYGGTAVWAVRRAVEADYKTVRYSGKERDATGLYYYGYRYYQPWAGRWLSADPAGMVDGLNLFRMARNNPVAFIDRNGLNSELLYSQAFKRTANKYNVIIGVRAPNPLGETLLKEGFPSKNFHMKAKSSPTGPTAGFIAEDPIYSKVSPSAYKKQRASIDKAKALGSESIDLFISKSRINELIDTGNLNSLGENRYSAKYPYGTQEFEIGNNGRVLNSEGKPVKVMTNPPEIGERKSNSSPITADYDLFAIIPSVNQSVNERPLTVPHKLLRGDFSLPFTSPKGKNGMSEDVNMGNLHHFGKTIVNSLNKEINAEGYAGGKLVWHNDEAGNPFSPGFDENDKPIFFLPSGGMFQAKNKSELLGFYSRLRRSGYTPEHSPIFGF

SEQ ID NO: 26 - protein, 874 aa, Yersinia pestis
MRTSLFSKTPSVTVLDNRGLTVRDIAYHRHPDSPDVISERITHHQYDARGFLTQSADPRLHGAGLMNFSYLTDLTGRILRTQGADNGTTVSLNDAAGRPFISASNISTSDDGTEDRGQAMTRTWQYEEASLPGRLVSVTEQVTGKATRITERFVYAANTDAEKSLNLAGACVSHYDTAGLVQPDSIALTGVPLSVTRRLMKSADNPDAVADWQGADASAWNDQLDGETHTSLTTADATGAVLTTTDAKGNLQRMAYDVAGLLSGSWLTLKDGTEQVIVKSLTYSAAGQKLREEHGNGVVTTYEYEPETQRLVGIKTERPAGHASGAKVLQDLRYEYDPVGNVLKVTNDAEETRFWRNQKVVPENTYTYDSLYQLVSATGREMANAGQQSCSLPSTTVPLPADSSAYTRYSRTYTYDEAGNLTQIRHNAPATNNSYTTKITVSDRSNRGVLSTLTENAADVDALFTAGGQQTKLQPGQHLIWTARNELLKVTPVVRDGSTDDSESYRYDAASQRILKVSRQKTNTSMQTQRVLYLPGLELRSKKSGDTETEGLQVITVGEAGRAQVRVLHWESGRPDEITDDQIRYSYDNLAGSCSLELGGDGNIISAEEYYPYGGTAVWAVRRAVEADYKTVRYSGKERDATGLYYYGYRYYQPWAGRWLSADPAGMVDGLNLFRMARNNPVAFIDRNGLNSELLYSQAFKRTANKYNVIIGVRAPNPLGETLLKEGFPSKNFHMKAKSSPTGPTAGFIAEDPIYSKVSPSAYKKQRASIDKAKALGSESIDLFISKSRINELIDTGNLNSLGENRYSAKYPYGTQEFEIGNNGRVLNSEGKPVKVMTNPPEIGERKSNSSPITADYDLFAIIQVLISQLMKDP

SEQ ID NO: 27 - protein, 973 aa, Serratia entomophila
MSTSLFSSTPSVAVLDNRGLLVRELQYYRHPDTPEETDERITCHQHDERGSLSQSADPRLHAAGLTNFTYLNSLTGTVLQSVSADAGTSLELSDAAGRAFLAVTGAGTEDAVTRTWQYEDDTLPGRPLSITEQVTGEAAQITERFVYAGNTDAEKILNLAGQCVSHYDTAGLVQTDSIALSGVPLAVTRQLLPDAAGANWMGEDASAWNDLLDGETFFTQTHADATGAVLSITDAKGNLQRVAYDVAGLLSGSWLTLKDGTEQVIVASLTYSAAGKKLREEHGNGVVTSYIYEPETQRLTGIKTERPSGHVAGAKVLQDLRYTYDPVGNVLSVNNDAEETRFWRNQKVVPENTYIYDSLYQLVSATGREMANAGQQGNDLPSATAPLPTDSSAYTNYTRTYRYDRGGNLTQMRHSAPATNNNYTTDITVSDRSNRAVLSTLAEVPSDVDMLFSAGGHQKHLQPGQALVWTPRGELQKVTPVVRDGGADDSESYRYDAGSQRIIKTGTRQTGNNVQTQRVVYLPGLELRIMANGVTEKESLQVITVGEAGRAQVRVLHWEIGKPDDLDEDSVRYSYDNLVGSSQLELDREGYLISEEEFYPYGGTAVLTARSEVEADYKTIRYSGKERDATGLDYYGYRYYQPWAGRWLSTDPAGTVDGLNLFRMVRNNPVTLFDSNGRISTGQEARRLVGEAFVHPLHMPVFERISVERKISMSVREAGIYTISALGEGAAAKGHNILEKTIKPGSLKAIYGDKAESILGLAKRSGLVGRVGQWDASGVRGIYAHNRPGGEDLVYPVSLQNTSANEIVNAWIKFKIITPYTGDYDMHDIIKFSDGKGHVPTAESSEERGVKDLINKGVAEVDPSRPFEYTAMNVIRHGPQVNFVPYMWEHEHDKVVNDNGYLGVVASPGPFPVAMVHQGEWTVFDNSEELFNFYKSTNTPLPEHWSQDFMDRGKGIVATPRHAELLDKRRVMY

SEQ ID NO: 28 - protein, 921 aa, Bacillus thuringiensis
MDTNSIYNGTPTISVIDNRGLQIRTLEYNRVTVEDPIDEYVTRNTYTLLGNLDDSMDPRLFSQYQNNDNTLPNMRYDHSLKGNILCTESVDAGQKVQIFNIEGRPIWFRDANRTQTTMEYDLVGRPTAVLEKLDGNETPKYRERFFYGENERGAQANNLCGQLVCHYDIAGRNQTKSFSLSGLPLYQSRQLLKNIDEPSNWSADGESAWINFLDTETYDTSWQYDVQGKKLSQIDAKGNLQTFTYNSIGQPKNIHIKLWGQIEQSIVNGIEYNAAGQVLRTEAGNGIVTEYTYEESSQRLMRKKDSRKIPSKRREILQDYHYEYDPVGNILSISNEMDSVCFFRNQIIVPKRQYTYDTLYRLISSSGRESDTLRQYQSFPSVITPIPLDDNQYVNYSEKYSYDRAGNLIKLSHTGATQYTTNIDVDVASNRGLLSLENNVSNFENYFDRAGNQKILLPGIPMEWDARNQLSRVNMVVREDKENDWEGYLYNSSGMRIVKQDTRKKQDITKTDTTIYLPGLELRTRQIGDNVTEVLQIVTAAQVRVLHWKDETQPTGITNNQYRYSVTDHLGSSSLELDKQGKIISKEEFYPYGGTALWTARTEIEANYKTIRYSGKERDATGLYYYGHRYYIPWAGRWLNPDPAGTVDGLNLYRMVRNNPINLIDPDGNAPIQITNYSKENGDLFYGLANERGRYIEAALRGKTFVSDSAESEPMIIDQYNNEVSKHILNKNIKGMKIAEHPKVPKDLKDIISTDKRGRYPLWDDYFTRGMENLKFNIGAIYKETKDKINTDTYHKYYTGGGADRVPKLLWKRGSKLGIAIAASNQKTKIHFVLDNLDIESIVAKRGDSGESITASELRYVYRNRERLQGRVVFYRNGEKLETTPWNDSPDLWEQYSPKNRAIQKTVQKNSFAGVFSKCIR

SEQ ID NO: 29 - protein, 927 aa, Bacillus thuringiensis
MNTPSIYSGTPTISVVDNRNLQIRDLRYNRLEKRDLVDEYITRNTYTLLGNLESSIDPRLFSQYQDDNSTSPNINSFPSLRGEELRTESVDAGRKVNLFNAEGKSIWFMDPNNIETSSDYDLVGRPIAVFEKQEDEEIPQCKDRFIYGEDERNALANNLRGQLVRHYDTAGRIQTENFSLTGMPLNQSRQLLKNMNQSSNWIIDDENTWTNLLDAETYSTNWQYDVQGRKVAQIDAKGNLQTVTYNILGQPKAVNLTLQDQSEQSIANRIEYNAAGQVQRTEAGNGILTEYTYEESTQRLMRKKDSRELSSEKIEVLQDYRYEYDPVGNILSISNDSDLVRFFRNQAVLPKRQYTYDALYQLVSNSGRESDALRQHQSFSSLITPIPLDDSKYVNYFEKYHYDRAGNLIKLNHKGASQYTTDIYIDDTSNKGVWRQKDEIPDISSSFDRAGNQKVLRTGIPLDWDSRNQLSCVNMVLRENEDNDWESYIYDSTGIRIVKWNNRKTKNTTQTDTTVYLPGLELRTRQTGEKFTELLHVVTVDTEIAQVRVLHWEDGTQPNEVSNDQYRYSINDHLGSSMLELDIQGQIISKEEFYPYGGTAVWTARTKVEANYKTIRYSGKELDATGLYYYGYRYYMPWLGRWLNPDPAGTVDGMNLYRMVGNNPINSIDKMGLLPEKPNIFTLSSQEVTEIKTKTDLSNMKINLSSIKMGNTDAKWNDIRENFDDIETNLVKIAIHYEREYKDKYSKNNLGPAVAVAYNLNSKKYHVGFNHVDGKLPEKKDSRIAERVPDQMSKGVSKLYKDWTKGAGSHAEVYAINSALLDKGKTDYKDTNPEDLILYVNRVNQGKTKPAEIRPFITCTDCAYTLVGPEVLGDLLGGIASVINQDSVLGLLTLEFPEDKIMEGLKIKTISNIKKYWVPNSSGQMVA

SEQ ID NO: 30 - protein, 680 aa, Yersinia entomophaga
MNQFDSALHQGTPGVSVLDNRGHVIRELRYYRHPDTPQEIAERIAFHQYDSYGFISQSIDPRLAERRKQDSSVKPNLSYFTALSGEVLRTDGVDAGTIFSLNDIAARPAISISATGVSHTWQYEGENRPGRVLSRSEREKDREERIIERFYWAGSDASQKANNLAGQCLRHYNSAGLNQTLSIALTGTPISACFQPLLESAEPEWQGTNESAWLELLTPEIFTTYNRADANGETLVQTDAMGNIQRLAYDVAGFLKSSWLSLKGGQEQIIVKSLTYSAAGQKLQEEHGNGVLTTYSYEAETQRLIGIRTERPAGHLSGARVFQDLRYTYDPVGNVLRITNDAEATRFWRNQKVVPENTYIYDTLYQLVSANGREMANIPQQSSQLPTLSPIDNNAYTNYIRNYHYDSAGNLMQIRHTSAAANNSYTTNITVSKYSNRAVLSSLTDDVDKVEAFFDAAGRQNQLLPGQTLSWNARGELAKVTPVARDGQESDSETYRYDANSQRVSKMAIQQSNNNTQTRRVLYLAGLERRTIHQGNTLFETLLVVKIGEAGRAQVQAMHWELGQPTEVANDELRYSYDNLIGSSGLEVDGTGQLISQEEYYPYGGTAVWMARSQREASDKAYGYSGKERDATGLYYYGFRYYQPWAGRWLSADPAGTIDGLNLFRMVRNNPIVLHDPDGL

SEQ ID NO: 31 - protein, 690 aa, Yersinia entomophaga
MDIQLFSKTPSVTVFDNRGLSVRDIAYRRHPDTPKVTEECITYHQFDFRGFLAQSLDPRLNHKEVTNFSYLTDLNGNIIYTQSVDAGNTLVLNDTEGRSVIAMTNISRGENGKDDLSLAVTRTFQYENAPLPGRPLSVTEQVNGENARITEHFVYAGNTPQEKNLNLAGQCVSYYDAAGLIQTDSVSLTGKPLSVSRKLLKNLDDTNILADWQGNDTSAWNSLLATEIYTTVTRTDAAGAVLTTIDAVGNQQRVAFDIAGQLSASWLTLKGGQEQVIIKVLTYSAAGQKLREEGGNGVVTTYTYEAETQRLIGIKTERPNGHAAGAKVLQDLRYEYDPVGNVLSITNDAEETRFWRNQKVVPENAYRYDSLYQLVSASGREVAGAGQQGSDLPSPLVPLPSDSSVYTNYTRTYTYDSAGNLMRIRHSAPATNNNYTLNITVSERSNRGVMSSLTENPADVDALFTASGSQKCLQQGQSLIWTPRGELRTVLLVARGETADDSESYRYDGSSQRILKISSQQTNHSARVQRALYLPGLEWRTMTGGVAEAENLQVICIGEAGRAQVRVLHWESGKPDGIINDQIRWSYDNLTCSSGLEVDGDGLVISMEEYYPYGGTAVWAARSHIETAYKTVRYSGKERDATGLYYYGFRYYQPWAGRWLSADPAGTVDGLNLYRMVRNNPLRLTDPDGM

SEQ ID NO: 32 - protein, 1571 aa, Acidovorax avenae
MATFVNDRRAIHEGRSPAMIPGPVNPVFPKPNGPPVPILNMAHGPGLKNGTATLKIDGQPVAIAGSRFESIPATPDRLGGIAGVRSTVVGGAAEPTSYSSDTKFESRGSVRSFDTTKSNSLVIDPGWRGRLAMALLPEPYDKLALKVIEKLPGAFEAEFAALGESLTDPSALIGPALKVIGKLIPGLNVLMNGAAMAQAAGQIDALAQKVQELLTPPMTDAKLDEIAQIIADEVAMITTQFVVGKIAKRARSRPGPVATGHDNRTNPNTTASIMDDARKGFAPNAGCELGTCHPVIFATGAKILADTDFELPGPLPLAWRRFYRSSDRRPGWLGWGWSTPLSIELALTYDAVHYYDARGRLVRLPVLPRGASHFDAREKITVRHHEGGGWSIEATDGLRHEFPAPVPGQWRLPLARMADRNGNAVTLHYPAYDATGADGCAPRPLGLTDSAGRQLRFEWSGEEGAPDRLLQAIHLEPRTLDGVQHAGGVLARYAYGTEGNEAGDLRANLAEAADALGGTARYRYRHHLMVAYATRNGFTHHQQWSRHDAGGRVVRTWTDTPGLLDTRFEYDLGRRTTHVTDALGRRSSYEYNAAHEVVAITEPGPDGRPVRTETRLDAAGNPEEARDALGRATRWRFDTRGNLLTVTDAAGATTRLAYGHLDLPVEITDALGHVWRQQYDERGNLAERVDPLGHATRWRHDARGLPVAIEDAHGKTRRLLWDDAGQLIAYTDCSGQTTRYTWDTLGNLLTATDALGQTTRYRHDALGRLRHVVAPDGSEHRYDYDAQGNLTAYTDPQGAATRYAYNGLDQPVLRQDALGGTLRYQHDAVGRLVALQNENDDTTRFTYDAADNLIEEIGFDGRIQRYRYNAAGELAELHERDARLPPDTPYDPDPAAPLPKRTVFRRDAVGRLVAKAHVGPDGVEEGAGSRDVTTFAYDLLGRMLQAGNADARVHFAYDPLSRLVEEVQEHLAPDGAGTLGRYAWRHAYDALGNRTDSRMPGGRHVQWLYYGSGHLHQIRVDGHVLSDIERDALHQEIERTQGALESRYGWDPMGRLVAHKVGRRQALQGQPGMPSPQALRDRDQGLPALPQLPSGDRIARQYRYDPTGNLIATRDGLRGDSHYRYDPLGRILAAQRGDGKQQATERETFAFDPAGNLLNPNRGAGPQASGGVGQRDVVPHNRLAVYQDLRFAYDLHGNVTERRIGWHTVQHYRYSPEHQIVEARVVRYRDRPAEAQGHAEPAATEQVTHYRYDALGRRIEKRDAFGRTAFLYDGDLLAGELRGSRLSEYLYEPDSFVPLAKLESEWKGEAAEKEGARPKDFAAYYYQCDQIGAPQELTDEQGRIVWAASYRVWGQTQALQVMRTGTDDAAVFTQAERPLALAAKGDVQALSFVQQPLRFQGQYFDGETGLHYNRHRYYDPVTGRFVHQDPIGLEGSENFYEYAPNPLEWVDPAGLNKKRKRCGCQLPCIVIDSSKYPETAQHVKEAIAAGHPDELTIDRPGSKARRRASLKGVKTKPTKDRDEYPPAMFKEGGKGADVKLIDSCDNRGAGSCMGHQCAPYPNGTKVKIKVK

SEQ ID NO: 33 - protein, 1604 aa, Acidovorax citrulli
MPKAARLHDPIAHTYAREGHAAGAATAVALEFGTAVAIGAAVGSIACPGLGTLAGIAIGIGVALVSFAIAHVASLYGDFAQSFGEAFGRSFTSDCGELKATGSSTVFINGKPAIRTGLDVAECDKHKMPPSLVIYGSENVFIDSYRAAREGDRVDCEAKISKGSEDVFIGGESVPIAEFRVNEVPESDREFARKARFWAGILGGGVSALKAGVKCFGMAVLTGVVGAKVMGEIMPSFDGGHSAATALGDGMGTAVGNLLQGKPVHVVTGAKVLLGDDDTDFSLPGALPIVWRRTYASCDARTGALGTGWSLPFSVELVFEGGKAHFIDEAGRDIPFDDLPPGGQMFSVPEGVQLSRGEGGAYFIGMPALGWIYCFGQRAGSSDGERLGLQQWADFNGNTIDFHRDADGVVRHVTDSAGHRLALRYAQAGGLRLVRVDLTAGGPAGTLVEYRYDTRGQLAQVIDRLGRCVRRFTWEGATLVAQTFASGLVARYRWDGPAPQGRVVQHWLEDAAPGMPATAWTFEYDLPGERPGDRRTRVTDHLGRVQLFDHDADQNVTRIEDPLGQVQRMEWNDLWQLLAWTRADGSRFTFTYDRLGNLNGATDPLGQTARLDWHERLQRVRAATAVDGTRWHYTYDDRGNRTEVLGPPLKPGTPPHIPSDGDEVRWRESTLHDPRGLPVVTIDANGGRQQWTWDERALLVRHTDCSGKTTRFEYDGNGFLSKHIDALGQITHYVHDALGRLLSVTRADGTAERYTYDGADQLVSAGDSSNRLTHYRYDIHGKLLALQRPDGSTVHLGYDAAHRLASLVSENGANYRFAYDTANRLVQEQRPDGSRHTFSHDSLGRVVELREDPGEDDVVGQAIRGHAPAAPIRTTCERDGIGRLIAKRVQAMTGAPSSQDTIEQRFAYDKMNRLVRAETLDAAGQSPAQVAEFGYTLLGDLAQEAAEDVVSGTRSVMRHTCDPLGNRLATELPDGRLLRELHYGSGHVHQISLDGVVVADIERDDLHREVLRTQGRWASRWAYDPLGRQRAQWTQSASLRVGGNWAQQMPDAANASGPGMLTDGLRKQWDYDAAGELVRTRHSRNGETQYRYDPAGHVLSATLQAAGAAGGLSPALQQALHEVFHYDPAGNRLDAPVPQGAEGSRGWVRHNRVKVLQDKRFDYDGFGRLVRKRIGGHTELHCRYDALHRMIAASVIRAGRDGEPIRQVFRYRYDPLGRRIAKEDDFGETRFVWEGMRLLQESRGAHNSTYLYEPSSYRPLARIDGTGPLEPEHPVAVLALAGEDPRGDPAAGKVRSIPVTNGDASDARHAVAGPVGATARYLAEVEALERGAGPDEPGQSTGRGGQARQTQSASTPSARIYYFHLQPSGLPEEMSDRNGHLVWRAQYRLWGNAVAEEWQAFDATGRPVNAPMAETGIRAQVSASPAPQNLRMQGQYLDRETGLHYNTFRYYDPDLGAFTTPDPIGLAGGLNLHGYAANPLSWIDPWGWACIPNKVAGTAREARVGAKLDGKFGASNVLRERYLRDANGKIVRDPLTGEARRVDFVVKGSDGKGTAIEVTSKTANKDAQQLKEARIRAQGGVYVREPGSKVLVEVRNTSRVVRVE

SEQ ID NO: 34 - protein, 2225 aa, Bacillus cereus
MEGKKQRKWYQYLIQLIVVALIVTSIPLNGLAETAPPFTPSPNSEQSPEVEKKEEQELPAPHPDQLKKDKAKAQASPTEIVEERTETEKVFDNNDGTFTKRVYTEPIHAEKDGKLEEVSPKLVEAPNEKIVTENTTLEPEFEKATQDGKYVQFKVKDHTIQYKLISANGEKGEIKPSPVTATHENNTVWYKGVFPNIDLKSTTFNENVKEDFVLREYTGHHIFTFALETDLTPSLQEDGSIDFQDEKKEKVFTLPKPYMNDSNVDQQSGEAVTSDAVRYNIEKKDEKTYTLTVTADPQWLQAPERKYPVYVDPSIELDNFENAYASSAYPTVNYSGGKLWDSGQNAYTLKVGYYDGTSGTNFSFIKPDVSNLKGAKIESATFHAYAVWHYYAHQPNGVWLDEVTSGWNVGSVNWNNKPGSNNIAHADVGRGKWAQFNVTNTVKAWVEGARPNNGFKLHANGNGQNHWKKFIAAENGTNAPFLEVKYSYAKPNKPRVQAYSNGSGSGSGHFNVQWDAVPGATGYKVAIFNGYDYEYIPVGNVTSWTTKDKKIFPTPEEIAQGRYWIHDDGKGAEAPTNPGQIYKNAYESGGPYGDYSGRSSYWIRIVAEYPFGDSPLSDEIVPFIPLEQVKKPDGSAYINATDKETGYVTLKWDAVPAAAGYKVWIYNGKDYEAFDVGNKTNWTTQNEKIWPTKDEIAKGQYLLHHDKKGAELAVDPSPVYKNSGGIYAGFKNYWFRVTAYSKAGHAESEISHEFVPKFAQDFGFIGMFDYWASVPVLNGTVNATNGNFIMSEKDITLSGRGPDVSVERTYNSQSKKVGLFGTGWSSGLEERILAEGNGNLLLISADGANITFTRTGDNTYQAPTGIYLEIKQVSGGYEIKDKDQTVTFYKSGDAQGRIEYTKDKYGNTTTYEYDGESRLSKVKNASGKELVVQYDGNNKKAARVIGPDSKTITFKYDGDLLVSSTTPEGKAYKYGYDNGLLTSIYDPQHTDAKPYKTSYAYENNRLVKVTDPLGKATTLTYNTDAKEVTLTNPKGRKTVYTYNDAGNPVKTVEDSGRLNLTTTYEYNANNLVKTTTPKNQTETATYDGNGNVTSVTDEMGTEKFEYNKDNGLIKATDNENRETTVAYKAANTEVSETDQAANTSSFMQYDQFGNPIATTRELGTGENLIQNPSFEMNNTERWNEEKTNSHGSLKKDATFAPGGLGGSSSLQMIVKAQNAGWGYHSAIQDVVVEPNTTYTLSGMMKTSLTHAGAFFNVQLLKEDGTPLGSGNNWFDTRHNRIEGEKDWTNRQVTFKTTDQTKKVRIYLQVDYNRADSSGSAWFDKIQLEKGEVSSSFNPIENSSLENMAGNGCMPGWIRGDGTSCDPKDVSQQESFTGHSSIVLERSQYGGSDVGYGKHITINQKKAEPITLTGMSKSVNVENTAPDKLSRDYSIWADVHYQDGSGENFQAKFPSGTNDWNRSAVVIPATKPIKRMEVYLLFRRENKGKVWFDDIRLLEGNALIKNEYDNDGNVVATYDEEGQKNTFAYDASGNKKSETDEKGNTKLYDYNKDNLLTKVTLKNGTSVNYRYDHNGNTTEKSVMFGGKTQTHKYEYDVDNKNTVYIDALNRRIEHTYDENANKIKTKMPNGSILESIYDTADRVVGEKRNGKDSFTFERDQNGQVTKVKDLVNGVERTKTYDKADRVTSATDSRGGKVDWAYHDKANSKTEKLKEQTITQGGYTNKVSYDYNTLDQNIRVTDGSQTYRFDYDDQGNVRTYTAGNGSGSTFNYDHANKIKDLVVGTSNSILLSERYEYDQAGNRTKIKHEGAGGKVTETNFVYDPINQLLNEALPNGTTKSYTYDGFGNRTSVKVVENGKETKSIAATFNEGNQLVKFGNESLTYDANGNRTSDGKYKYTWNEDDQLVAITKQGESNAFATYKYDENNRRIEKSVNGQVTRYFYDGDSINPLYETDGSGNVLRQYVYSTSGARLAMKSKGQTLYYHYNPRGDVIAMTDQNREVVATYEYDSWGNVLKSDAKGIAADNPFGYAGYMYDKEIGMYYLIARYYNPEHGVFLSIDPEPGDEDDPVTQNGYTYVDNNPVMLIDPDGNIPVAPLVVAGARMAAPHVARYAAKKLGKKGGHYVYRYARGRGFEKKVLKELGLAKNTKKVMGRIPDSLSKGRITEIKDVRKISYSKQFKQYAKSGKRIDLIVSKHSKVSKPLINAINKSGGKIKVRYGKNKYYTYR

SEQ ID NO: 35 - protein, 1074 aa, Bacteroides thetaiotaomicron
MQNMKTIEMKRTLSILCLLSFSLFMNGQQATGYTKTRNYTAERTYMDASSQTGSGAARIVNDIVYTDGFGRKEQEIQIGGSPGGNADLVLSYTYNMMGQVEKEYLPYAKTGNNGAFDKFSPERWSVYGTGEQAYAYNLTQYEDSPLMRVSRKMGPGKAWHTSDKSVRVTYGMNSTNEVKCYKVSSSGSLIASGFYGAGKLEVIVETDEDGHRSKTYTDSNERTLLTVSVNGEDSLATYYVYDDRNCLRYVLPPEASHQLAETDTTDISVLHSLAYSYEYDKLNRMISKRLPGCAPIYMVYDRRDRLVLSQDGKLRTADAKKWSYFLYDSHDRVIESGEMLLSAEQTCGELQLAAWESEHYLPAGTRTPLQYTVYDNYKPTENVTAHPFVAAVGYDTSYTLYPSGLTTSTKTRLLGTDDWLTETIYYDDRSRVIQTLCHYPEKGLRYSHTAYDFTGNVLRKQDNIGTDILETVYTYDDRARLLTKANTWNGRFTDKITYVYDALGRLTGRNYGDKVSESLSYNIRGWLTGIESQHFSQTLHYVDGVGVPCYNGNISSMTWHSGSEAGLRGYKFTYDGFSRLKDAVYGEGELLSNNTNHFTEQVTGYDKNGNILGLLRYGQTNTMSYGLIDNLNLVYNGNQLESVNDNATGHVFGNGMEFKDGASKEIEYEYDANGNLTKDLNKKIADIQYNCLNLPEKVQFEGGNSISYLYAADGTKLRTTYKTGNATIITDYCGNAIYENGVLIKVLTEDGYITVSNNQFHYFIQDHQGNNRVVVTQNGVVEEVNDYYPFGGLLSSSLSNNVQPYKYNGKELNRDNGLDWYDYGARMYDASLGRWHAVDPSGEKYPALGLYAYCKNSPIIRIDPDGKDDYVVNANGAVYLMRKTDRIVDVLYASGINSSQKATQPDPNWKSIRVFDKSMLQGLTASKGEKGRDYWDRKLYTTTNSVYNAANVFLFVADNTSVEWTLKGGYMDGKRTFILGTNNNRNRVSSMYGLTKVQEALFPTFIPIIDIHSHPYNPFASPEDMDNARMLRDIRYGIYYKDNIINYTDQNNSTYSIKVNSMNDLMRYIFQQLR

SEQ ID NO: 36 - protein, 2502 aa, Caenorhabditis elegans
MNNGDPVAGGPMALSKKKKKFDDDSDTCSRWPSKWNILLAAALLVALFVICILLFRAPNYVYTQPAPSSDATSSAAAAASRYQDLGLRALPPAISLGERVDVEFFPKSMATTELTVTKPSRIRFNATVGSGAQLVLLMSAGVHPSLSLHDALFPIRADRIRDSKSPTHIVEEFGSRSRRSLGASSSRHRNIEILSPRSATFEQFVLEGRHYLTFINERSRVEPISFVAEELQRPTTPPKTSSSGTSGAKEHPLASVLVCESNCNQRGECVHGKCHCAPGFTGRTCDEAVCPVVCSGNGVFSGGICVCKSGFKGKECEMRHNWCEVADCNGRGRCDTDGRCRCNPGWTGEACELRACPHASCHDRGVCVNGTCYCMDGWRGNDCSVFADAIVHVPQAQSPPRRGQEPTESSKTRKAQVKPTPTSEKKKESRELQKPIIATVQVPTESSHPCSAHGQLIDDICQCESGWDSVDCSQQACQCVNGDCLDDGSCQCWKGWRGSNCTDKKCAIGCEDRGKCASDGSCKCSSGWNGENCAIDGCPNQCSGKGECGMDRRSSEWSCRCQAGSTGVDCSVSVEMHCDDGLDNDSDGLIDCDDPECCSSSSCSSESVCSTAASPIEVLMRMPPIFNANFAQRVGFLIMEKSVQSYTDSSQFNENLISVIRGRVMWGGSPTGSDDLSTYSNKSTVPLVGVRVSDAAHPLYGFTLTREDGYFDLTVNGARSVTLQFLRTQFQSVKKSVFVSPRQIIHIDDIVLYRQSGGSPPAISMAPARAKCSPTLRRIPDVVLISNWQYTSDGIETDETSDSSRIVVDSRSIFESLPIQGTDVRLVYDSARSPAAPSTMLIGLLYDRVDKELRKVHINIRIAGRRFDRVLAPRTNLTYVFAWDKMNAYRQSESGLVPVTVRVGYEYQGCDRTSERVWQTRRSQMMGATARKMIGTMWTLDIHHHLDIVNNVVEMGNGGYRLITESEPRVSTFAGLDGVKRDVECLKCEGKVDSISLFRPTTVVYAQDGSLIIGDHNMIRRVSQDGQVSTILTLGLADTSHSYYIAVSPVDGTIAISLPLHKQVWRISSLEPQDSRNNYDVLAGDGTVCASAVDSCGDGALAQNAQLIFPKGISFDKMGNLYLADSRRIRVIDTTGHIRSIGETTPDQHPIRTCAQITKLVDLQMEWPTSLTIDPITGSVLVLDTNVVYEIDVVHDVVTIALGSPTTCDLANATSSASAKSLDHRRHLIQNARDITVGTDGAIYVVESDGRRLNQVRKLSSDRSTFSILTGGKSPCSCDVAACGCDDAVSLRDVAASQAHLSSPYAVCVSPSGDVIIADSGNSKIKKVSARMAKYDGRSRTYEVTDAERQEKYTFNRHGQHSSTVSLITGRTFFNFSYQVDSPISMISEIRAASGVVLRVLKRNDSLFDLETTLGQRTTLTMSAYDGTLEQVSKRDSATSRDATKLFYKKGLLTSRIDVATAVGFEYDEYGRAIGLKRDREYWRLGEETISMGSVNTEVLLNGQRFQQVRLGEGNLAVHSTNGATTRLISLRNEGYSLASPLGTSTLYDKSSSIPDSNGEPLISRRRTKVPAIGNPQRRELTTRWDWRHVARRGDDSDGSLGRRKVAEINGVNMFSMEYDVKSNQDTLRLGSTTDDAQALLFIDYTSSGRIRRISAPEDSQMAEMNITWDGAGRKSEVTWGSWKIRLTYDNSNRLTEHAIDGARVPIKMSYAGASRRPNEIQHDGAKWNIQYDNYDRIKEVISKSQEATSFSSIALGGDEWVLKRRTSLNSKPSLVRLSREGKVLESTTPDENHYWLERKDPITGRTTEILNDEETTVVTCWSPEGAPMCSRSRNLQENTTMQGHLVARKSVTIMTPTSSEPSITSSFTYEYDDMLRVTTIQPVIEQSVLESIQLSYDERRGHVAAINGFKWARDASTSRCQGHGLMYETSKANDHRQVVERKLIFGDARASIKIIRDKAGRASESHLEISSSGTQRNQKITRTFDAAGRVASVEQNDQEPVRIIWNSDARVEKINDRVVEWNRGGALKTFQDISYQVDSIGWVVKRDNTTVFGYDGKGRLVSARSSQLRINIFYDREDRVVQIQNSKDFIHFYYGYIDTPKLVSHFSKNGKISTLFYDDDSVPFAMQSDDGTRYALLTDETSTIKAIIGDSNVLRIIDRSVFGALLPSSSSSHPFLPIGYLGGIEISEISVSILNNGRPLDLYSERYMSISPEAVVRLELNEKFSNSIDLMALEIDRQPFRVENVPEDFETWFSLAGLSPNLLPSAHLGLPASSAIVHRLLSSFPRKLRPLTHLTTVLPTRLASDISLTSPTSETSWSIDDVGFSNLLILNEDATTGEVMVEMLSDLKSEEREVISKLFDGVKSLDFATWGLVPTRHLWRAPNSKLELSSTSFSHFTMAVNKDSVELRNGKSKIVVHFSENKAEIVKKIVEELKTRENIAVWRAERKRAEAGEKTWRQWSDRETRELTSKGSVSGYDIEMKPAHQSGLLASVHSWKFRKSE

SEQ ID NO: 37 - protein, 2245 aa, Cellvibrio japonicus
MVLSSYFAFLKKICSFLKVTMGALFLFALCSATWAGGVKLGQGKLVSLAEGTLLYSSPGSANRGDFGRAEISRDIIALADSIELMAERNSSGLVNASYIAHAYAYVKSEIAPEFRFGLSKGGFGALLDKSGTPFDQAQLLRDLLAAKSISANYVLGKATLTGEQFQVWTGINTAREACRLLANGGIPAEVNGTFSADCDYAGAVSSVAFLHVWLSVNVAGTVQLLDPSFKKMTHKNPLDLVALTNYSRSALAISAKNSNGSWNISGLNNALNGIAQTYYQNVKNNYPNQSSLDVLGGNTITEKIVNATAGDLTGLAYSGQQINSVESIPDRLRTKLTLSQLSTPNNTVSPKVFNFFADETYGATISFAPPAHANAYDYDNIYCHMVFDGLTEVHRSYLQFASMVVEVKVDHPYLSANEAGTTSSYMDNTSRFLLNCRMPNTLVLGLGNAGKALAERHQQQAKETRYTSSFGAENGNPILSDFAMGWQQIIPVASEYLYEQTQRTQFVAALGKANIEHHHTVGLASTLVKIDKPAGGVASVSQQSLELSLDAAMSYTPKEPINVLYPDDIQNIPPQVVSTSGCTWNLVHSQSGVVAVYQLSCYGIIKTITYSGSTQNCSLTAGAGYNVSGNCNNFVVTQNTTLQASQAYPANPIRSGVGRALSWLLASLEGEVTQRINGGVDAYSTTHRFAWGVANDVSFGQYSGGATIPRPNVTIFTAPETSAGTTISINLEQSGGVIADKMVEVATAYKNKGYKIIMPGVAVMGPGEFVWSRFYNSCTGCVAGYNYVADLGMQYGSAMYAENNQTGDYVHYMVDYFGMNRGGGSGTRAAPTLDGGKLEAPKPDSRQKIEHGVQKNTGDVAYNFNSIISVGPEFPYGLSADIAIKTKRGEPEFTATLTPGTNTGLWKRIERQFEVTNAGSASFVSDSINLLGKRTPLEASYAVAAVMALLDISHSGRQDLHVFNALIAKWLADQVLESTVNISSPNGSDEYVRHADGYFYAKPGSPESVTVSLTRNLAPSGVGQSCNLSTSSPPNPNDIEWLRSGYSRIIIGDVVRTLKNGDKEKYNARSYVTSRFDCSAKNPWHPLVQYSNNKGVEVNYTYNGFKQLTAISNNLGRTLSFVHGGHPDTGYNLTINSGSRSASVSENISENSIAITKSDGKQWIAKLANPAQAGKLILHGQALEAIYSPEDTDNPIVQYHYNNLWQVTAVDLRKNESSNWNNAYRWGVLPGYANIEVDIADSKTIDYFDNTGNTVYQKDAMNHFTVTAHDNTHRAVDRRIFESSVALRAISNLAHPWPSDLPGYTAYNGSFSKREVFQYDASSNITKEMLYPKIGAPDADQPLVISRTWQPVYNLLKTETFRYAEGTTSQVSVTNQYNVTTGVLEQSTNHATGLTTNYENYWMGLPKLIKESSVRHIALTYDSYGNLTNYTVQKPDGSGKITTTAEYNDAVYGNIGNVSKLTDPNGNVTRAQYNADRSLKFRWDAQNTKTTFGYTLGGQLNSILVDGNARTSEVTAGYNPLGWMVWLKDADGDTQYFDYDARGLLEKSTDPMGRARRYDYNRAGQLICQRDGWGTGLQRTYKHLQYNALGLVTAYNSADSDPNSDCVLDNTNKQTTVQYNAYGQLWKTTFPNESPHGITYEQFEYWPGGGVKTKVNRRGETVSYTYKNSNANPSLVDVKTVGAGSSLYTVNYTSYDVFGKPTAISQTGLNPNTLTFTYDYADRGVTESSQKIGSSGVVRKVINRYDAAGNRSEIVWPDNYTVKYVYDALNRIDQVNAGSLKLADYDYDDLGNLDKVTYGNGAVSDYQIQKDGDLDFIEHKFVGGSNNVKYTYSFNTAAQLISTSLSNRSFHWRAPSTTEKLYGVNKLNQYTSVGGVAFNYDKAGNLTTGQLGTFQYDAENRLLQANIGAAGPQGALVANYTYDANGRRTQKTVVKGGVSTITDYLSDGDHEIAEYAANTSTPSKRFIYGKNVDEIIAMQDVAANTYSYAHRNHQGSVIAVSNASGQVTSNNIYTYSPYGEVNSAAGFPFRYTGRRLDPETGLYYYRARYYDPGLGRFLQTDPIGYKDQMNLYAYVGNDPLNKIDPTGKNAKKPFLKEAAKELRKEAKRQIKNAKAQGRREALKQERQQLKETGESKSNLSDDRKTELLETGKLKNMDGHHEPSVSSGKTLEEKIDIAKNPDNITFMEKADHQAKHAENGGTQVPIGAIALGVIADGLDLLSQIPDPTIIFSVPKVGCAELNCPSE

SEQ ID NO: 38 - protein, 2203 aa, chloroflexus sp.
MLWQRRAQRWWSWFVAWIFFITLLPPTGIQADPQQPPVTEPPPAPPPPAAVASLQLAPQPPDPGIPTLAGAVTVSPDPLSPGTPALINVTIWNRSPYVARDVTVTLAGPKGILAGLPAESADTATKAVAVVSPADHTWQWSIAELAPYGTAVLTGTIQVDQPLAGQAIVLQGQIQAAGVAEPWFVRGGALIDTKPLTTETTFDPGRTATLNLPDAPVTVEMPATLSRRRLTVRYTTQSDRRSVVPPPEIHGRPHLGTFYLEAFDEQGKSVRTFDAPLTIRVRYTPEQLAARGIAESDLTLFYFDEEQSRWIPLPTTVEPATGIAWATVDHFTPFTLGDGSTISTTYVPSLQGFQVGTFSGAMSYGIQIEVPAGPGGLKPVVSLSYSSAASDGPGGLRELWQAGPVGKGWSLNAGGSVMRNKSLAGSNWDHFSLVFEGRSFDIVRGQLLSPCTDYQNGAALECWSWHAVDEHFVRVRAEQSNGTYIWRAWTTDGTRYDFTQPLWNRPDTDVNTPEIYGWLLTQVVDVHGNRIEYLYHIDVVPGTVFTPTWYLAEIRWGFDGATPGTGTPRYRITFETADRATGISAGVDANYEHPYPGNAYWRQITPHQKYRVDSISVWSRPGANYELVRRLVLSYASLNESVFSDARNGQRVLTLKAVQLVGSDGIQALPATTFTYHPRDTSVNAPNPGANRLATITNGQGGSLTITYEKTFPANSSWLEINYHRVASVLRSETAIPGRSTQTLTTYSYSAPALNTRTHAATVVFAMYPPSGNGDSRQFMARPEAREFRGHGRVITHVYAGNTTSTPLLKRVVEYFYQGNGGPNLDAFQTCNPALVTLPNNRLAVNESDPCFQRMVVYEAWKGRPYRVEITDEQGTLLQQTTFSYLHVPLPFFGADPQVPNSATLSNNYRRAGLWRAFSGEQQQCVNLPANGSSVERCTVTFYDLSPGHNTNSNQQPYGNVTRRDLIANGVLIRTTRQHHTIVDQGTVYLTNRVWVTVVTDGQGQRIGFSLRFYDGATTQAGIGTRGLLTREITFNVPPGTTTIPNGMTISGRDHTFTYDASGQQVTSSTYSGAATATYQNGTWVVSAPGGGSPARTATTVYHQVYRWLPVQYTDPSGATSRAVYDLRLGTLIEVDGPLNGDNSYSCTTSAPETIIPTLTDDVVCATYDVFGRTTSITRPGDRRVEPSLRIWYADAELPVRYTLQERDGLSSSDPYRTTHHFYDGFGRLIQTAQETSDGTAIQRIIREKRYDALGRVIQQSQPWLVNGMGATYQPPDAQVRWTITTYDALDRERQVIDPLGHTTTITYGVGGTGSDRYTIKTVLTPRGVRTDYRLDAQDRLVEVLEYPFSGTARVTRYRYSALDLLREVVRSDGSITTITYDGLGRKTQLNDPDVGTWLYVYDINGNLIRQIDPRGQRLCYRYDVVDRLIGVHERLDDGCPADPVHDQYVYRYDNAGRLIEHAVRDGVTVRWNYDARNRRLSMSQSLPAQPMLTISWSYYANDLVQSVTYPDTNGTSEIVTTSYNAGWQPTQLTSSLDGVIVSHGRYNAHNLLTDLHYPNGLRERWDYDAAARPTRWLLGTASAPGSIVDRSYAYDGHHNLTRIAEGSAIQTFAYDDRDRLIRASVLDATTRSPTLTIRARGTAAGGVWPSMALRINGAIVQRWTVTSTTFQTYTYTHPTPLDADQTIDLLFENDGVVGNDDRNLFIDTIQIGSQVIHAGQRGVSYDRGALDGRDVYASTGALYWNGALRLTEQYTYDSVGNLTRKADLPITYGTAGNGPHRPTTIGGQEVRADAAGNLTAVNGRQIVWNAHGLPASVSTAGVSEQYGYDATGARVTVISNGVRQRVVGGLWEQHGSSIRHVYTLGQRLVGVRDVTSGTCTFLHLDHLGSISVATTAQGSVIRQEYDPWGALRVPAVQAGHVPITATNRAYTGQARDASGLLYYNARYYDPDIGRFLSADTIIPGSPPLTVWPSDATAQGMWRSAGSGPVNPQDLNRYAYALNNPLKYTDPTGHLPLLPVLLVGGIALLKAIDYGWTAWDAFQATRTLADPQASVEERRAAAANLALTATLEAAEPDDLLPVGLPLDDLLRLGIIGGSKGAGSLLPLGRSFGQYGTLVEDPGISITLLTYHATKQHQVTREMVEAWQQLPKAVLAQHNGQRFLCITSEGAYVIDRAGRVVTAYPRSEFKPKLIEIAKELGIIQ

SEQ ID NO: 39 - protein, 1730 aa, Corynebacterium matruchotii
MPVLPLKPFLAYKESEFKIGGNTAEVFDFARRWKTFADNALTCASNLRSINDGGFLGSEGDRYKQLINSDFPSHLTTTGEAHNGVSTAVHQYAEALTTAQTQMNTLITTASVNHAAVQTAVANYNACEINLARAVVTAQAATTTAAATAVVPGVNVATASAAATAQTDLTAAQTAFEAAKTEHTRATTTFNADVTTASTIKSTLSTAVNSAVTSIRSQAKKRFEENPGWLEEKWNDFKDWVSEHADVLSMISDVLQTIGGLLMMIPFPIFTAIGAALLVVGVGLKAILALTGNCSLLEFAFDVATCVPGGKALKALKAGGTALKGAKPAKAISKASSTASKASKASSTASKASKASNAASKGEKSAQKASKTASRGNSCKSPGGEPIDMATGEMINFVTDVHIDGMLPMVVDRNNSSDLDTSMVFGPGWNTSLDTRIEVCPDKILMMSPDGAILEFPPAPADGAEVVANGRPWRLSFVDGAYRVRNIQEGITWVFAVTGSEFGDRRPDAPIQDFNVTGDAPKNVVHQVEDTEVSNSFVNVLSPGSVADAFGLSVEIRLSSIVHHSGAWIEYDYEQTTGHLVSMRRSDGTTLEFKWHNRVHRLLSIWVKNEETHPDEEPMRLASYNYDGKGRLLKVINSAAGALRYYYDDADRPCRWTDRNGYSYYYRFDDQGRVVSQVGSGGMFPNVVIWLPDTGDDAPEDGTVCVILECAGEFHGDPAEIGDSCINEYFDRLENLPLANLLREKGLVGAGLTGRGRTSARDDETWTIPEELLHDEFLGDIRPTVYRSTPAGDVWRIVTAEGIVTDWDHDQHHQITRQMTNTGVVTVLERDEYGTITQIDYGDGTTETIVPGAWGEPVRVIGRDGLTTEYEVDPAGFVTAVTDPAGIRLEYEYEWRATGLVPLAMIDPQGLVQVTECDNAGRPLVSVDPAGRRSSVIRDVRGFIVETIDPVGNVTKVEYSPEGWATKIINPDGSERSASYDGEGNQITATNEAGVTTTAKYTVFDKVSEIVAADGGVTRYTYNTQMEPITVTNADGHAWRFEYDWDGEVIKETDYNGLVTETRRSRDGLRADIINGEGIVTTHYDAFGRLTEVHEIDDVVRFTRDKLGEITQVSNKWSTVDYQHDEYGRTISETTTLYSGEQTTINLSHNPNGVIDSVSHVLPDERVISEKTRFSEGGDVCELAYSLDGKEVAVAGLGVDALGRRSWITVDSTVRKLKFDKRSRVVSETMVKLGGEAATTSIVDRAFSWRVDDVLEQVKDAVRDTTTDYVVDSLGRITSVTHVDAARDQKPSESYGFSRAGMLTKLHPDTSAKWADDVDLYGGTMPRQIGRTTFTYDKAGRVTQTVTKRLSKKPLVKHFYYGSGTQPVGYEDSDHPGVGWRYLYDGLDRRVGKEQIDTVTGDVLSRTVFMHQGNRLFGEQRTVNAHEPRLVGSGKLWPVDSWTGDVMGQIEIAASSGPVDGWSQDQVDAVFYAMISDFAGAPRELVDVTTGGIVGYSKQSLFGKRTWFGEKSSPLLFAGQYEDAESGWVYNRFRYYNAAFGMYNAQDPLGVGPNLASAQAYVDNPTTWVDVYGLSHSQPSKKAQQLAQNRAQGKKAEADVRKVMQEELDAANKADPAGAGKRGIGEQVAMKTSDGSPTRPDFTITNGQNQYKVFEVKSGNAGLSNGQTAMQRDLSSGKPVEVRATSRGEGIGLSQGDKFTGTYSVVRPDQPGALNNLRQTLQQFWSPPAK

SEQ ID NO: 40 - protein, 2058 aa, Desulfatibacillum alkenivorans
MSIGSGVRIRFGYFAIIALIVFMAPATGWAVFSETFTETSTFSDKFIQTGASSYSVPLEVPPGRQGMAPNLELIYSSARPNGWVGVGWVLDMGAIQRNTRLGLDYTADDYVFTKNARTTELVSRSTDWGADMYGAKIESKFTKYEFKAGSGDYWVATTRDGDKYYFGQTIASRIENANGDIFKWCLDRVEDSNGNYMTISYTKDQNQIYLDEIEYAGHTSGVAATNSVKFYLEDTRTDDAPMYQSHMEVITAYRLKSVEMIANNSTVRAYSFNYNQPTLSKRSWLTSIQKYGDDAVLDVDGDITSGTSFPPVSMSYQTCALGGSEECWGKHDSLYLPAGRYGGGYADWNGDGTTEIIFITNSLMTYLVPTESPYPPNGFAQEHNILSSANISYPGFAINTTETFMGGFGDFNGDGKADYVYNRLTNTLQEGDDIAVVLSTGTGGSFSVWGAKSQDIEPDDYGIGDFNGDGFDDLMYRQDRDDGDNMYVLVSNGEDAFTESLWSTQALSHTYGPNGVGDFNGDGKSDWCFVNSVGMFLVKLSNGSGFEAQSVWADRGVGYFVKIQEYGFGDFNGDGLTDYCWGENDVQWTAWNDYENGSTQTMPEETYYVALSTGSGFDIQQWATFNHGTDVYGTDGYMSFSGLGDFNGDGRTDLSFANSEGGVHMMFSRGDSFEHYSWTGFSHDLASGEIQTTASYQRYASSLTPRTTEYGINPFEQFTEGWPAPTALAGLGDFDGDGKTDFIYSFEQDAVTMDFFGGSIIIEPAIPPTYYVLTTNAGIPDLLTEVDNGLGATVEYEYTPSSEWDNDYLPFLMQNLTSVTVDDGLGNTSTTELSYSGGLYDPVEREFRGFETVAITNPDATVSVTDYEQEDDFLKGRPLTHEFHSATPGTNTLKLSTTYTWASDTITWESDAITPESKFVYLTSKETDVFDIIGGVSTTASEKNISYAHDSDTGLTEYEIVTGSDYETGTGPSIKTAYEYSQPAGVTEWLWRLEEEAVYDYSTLTVKAQTDYSHDVYGNVTDVEYWLDGGTSPSVSYTYDAYGNQLTFTDAITNTWTTTYDAVAHAYPVTTQNPLGHTTSKTWDQGFGAPLTSTDANNYTTAFTYDAFGRLEQTDTPDGGTTEIVYTDTTCPRTVLTRVYDTATSYIASTDYIDGLGRNIQHVESTENSLYTVSQTEYDEMGRVIYQVGPFFNGTNTASITAPTTDVHYVSTEYDYFGRATSIATPNTSSTVAVTEFDYEGPKTTVTNPDDGITETILDYLGRTREIVEHNDSSLYTTAYSYDVLGQLTSILDDKGNTISTAYDTLGRKTQMVHPDMGTWTYSYDANGNLTSQTDAKSQVVNFTYDSLNRITQKYYPNSSMGSVDYIYDGYLGLGTDSVGRLTFVQNSESYYWIKDYDPMGRISSDGRCDRSQPMWYDFSYTYDLAGRPTSTEYPDGMEVDYTYIPGTSLWSQVISGTQVLAEFSGYTAHGKYELVDYANGVTTEHTYDPDSTRLMAIQTSYGATDYQNYAYTYTDGGNIASITDNMRSHAYTYAYDDLHRLTGEASTTGSMAWTYDSIGNILTKSQDGSSMTYAYNSVTHKLDTVTAGGTVYNYSYDANGNITACPKLEGAGSISATLAIDYNVDNMPVQVVKSVSGQPDVTTNFYYDGNGARVRKEVVGESTTFYAGSLYEVKNGVATKYIFGADRRIAKITDGEGIQYFSKDHLGSSTVVTDESGAVVEQADYRPFGEDRFYTGSVATPTPYKYTDQELDESTGLYNYDARHYDPAIGRFISPDSLIPNLYDPQQLNPYAYCRNNPLIYVDPSGHYTVGGEEGRDCTGGALNGGGGIKGIGSLLNFDRSFGALCYGLKTGEMPLDVGYRGEPGGRLRGKLVASNSSIADMIIQGVLSGPSPAPEEEQEPLKQNDLPGSSEEELDAEALKDALVFFVECQQDTIYSAINIGFPPSTPITAAMRVKPTSSRPPSLTPPGAGRRGAFRQAKRDWGIPVSQQPKKTGPNLDKRGNVRPGRAYTFEVKGKGGKTRTITIRDDAGGDNYGPGNPQNRGSHINGKKGTHYDY

SEQ ID NO: 41 - protein, 1457 aa, Dickeya zeae
MLNDILSRVARVGAMHAGNRPNPPADRPQPCQGKPPTSPGKTIKHKSFLGALAGAVAGALVAAAVFTAAAAVAGAIAVAAIGTGGMGAALVVGVVKLAAGFGAVSLLGGLIDAVSSKVSAMVDSGSPSFGPVMAGSGNVFVEKQPVARATKDTVACTRHNSPQLIAQGSESVFVNDAPAARIDDKTVCGATIKEGASTVFFGSGQGTYLEIAEEFTALQRALLIAVEFLVPPSRGMFKGLGKLFTRGPMWVLKGMRVGALKTLKGLKSAVKCASEGFRNNKGLSRVTEAVRGFLKDPVYIASGEVIESRTDIALGQTLPLVFERTYRSASVHTGLLGRGWHDSWSEVATVTRDGLNTHVVITLAQGYDIDFTFHQDVQAVYCPHYPEFTLHRRGDGFSLWHRDQQTWRDFSVVQGERRLLSAIHDSHDNRIELVRDPKGYLRQVRHSDGVTLLLVWRGEFLHQIQRIDGGQKTLLAGYRQDEQGRLVEADATHAYHLYYEYDAAHRLTRWHDNDQTWARYEYDAQGRCVYTTCADGFLTARFDYLPDRVVMTDGLGQRSEFGFNDLHLMSWEQSPLGHVTRYEYDEVGNLLREISPAGRVVEFGYLDDTGRVSTFTDASGHQWQYAYDDEQRLCGVTDPLGREWGWAYDAEGNPERLTGPDASEVRFTWNRYGLLTQVSDAAGEVQARLQYDHRQRLLSATDAESRTRQLRYDGQDRVVQWQRADGARFRLGYRRASWTLPEQLIRPDDKEEQRQYDRHNNLLSYVDGNGALWRQTFGPFDLLTARTDAEGRTWHYAYDKESQQLTTVIAPDGSRWQWWLDADGRVVRERDMTGTETHYGYDEDGLCVSVRNGEGDTRHFLYDARGLLLRETAPDDTLHYRYDAVGRLTEVSSATAHVQLDYDLRDRVVREWHNGTLLTRQVDDAARTVTRTLTWDGDADDTTNTLAPLTSLFHYTRTGELRQVQLPDGADLTLTQDAAGRESLRTGGSGFVQQREYDVMGWLTREMSGAQHDGHLQPAQTREYRYDGAGNLTGVRHNRDAEGYRLDATGRVQAVLSGGAGKPVDTTARYHYTRSGLPQEAGRLTEWQAGRLVQHDDTHYQYDRAGRLIRKQVLQPGYRPQVWQYRWDSRNQLRVVDTPTGERWLYRYDPFGRRVGKRCDQKAEETRYLWDGDQIAEIRHYRHGQLIQRRHWVYNGWELVVQQRQHTGGDWETDFVTSSQNGVPQALFTPDGTLRWQAPTATLWGQRQAEKSESPDPGLAFAGQLRDSESGLCYNRFRYYDPAGGCYVSPDPLSILGGEQNYAYVPNPVGWVDPLGLARCNGLPSTRKPGGTGASYDSINGQGLYILHEGGKIKYVGRGDAPSRLDIHAQTPGKSHLEQLIIFDNNLTKAEAKFLEEKLIGMHGGAKSMNSLTNLLNKIRSYSPSNPNAANYKVAGDNSLWGNEILKDALSIIRGNT

SEQ ID NO: 42 - protein, 1411 aa, Escherichia coli
MSGKPAARQGDMTQYGGSIVQGSAGVRIGAPTGVACSVCPGGVTSGHPVNPLLGAKVLPGETDIALPGPLPFILSRTYSSYRTKTPAPVGSLGPGWKMPADIRLQLRDNTLILSDNGGRSLYFEHLFPGEDGYSRSESLWLVRGGVAKLDEGHRLAALWQALPEELRLSPHRYLATNSPQGPWWVLGWCERVPEADEVLPAPLPPYRVLTGLVDRFGRTQTFHHEAAGEFSGEITGVTDGAGRHFRLVLTTQAQRAEEARQQAISGGTEPSAFPDTLPGYTEYGRDNGIRLSAVWLTHDPEYPENLPAAPLVRYGWTPRGELAAVYDRSNTQVRSFTYDDKYRGRMVAHRHTGRPEIRYRYDSDGRVTEQLNPAGLSYTYQYEKDRITITDSLDRREVLHTQGEAGLKRVVKKEHADGSVTQSQFDAVGRLRAQTDAAGRTTEYSPDVVTGLITRITTPDGRASAFYYNHHNQLTSATGPDGLELRREYDESGRLIQETAPDGDITRYRYDNPHSDLPCATEDATGSRKTMTWSRYGQLLTFTDCSGYVTRYDHDRFGQVTAVHREEGLSQYHAYDSRGQLTAVKDTQGHETRYEYNAAGDLTAVIAPDGSRNGTQYDAWGKAICTTQGGLTRSMEYDAAGRVIRLTSENGSHTTFRYDVLDRLIQETGFDGRTQRYHHDLTGKLIRSEDEGLVTHWHYDEADRLTHRTVNGETAEQWQYDERGWLTDISHISKGHRVTVHYGYDEKGRLTGERQTVHHPQTEALLWQHETRHAYNAQGLANRCIPDSLPAVEWLTYGSGYLAGMKLGDTPLVEYTRDRLHRETLRRFGRYELTTAYTPAGQLQSQHLNSLLSDRDYTWNDNGELIRISSPRQTRSYSYSTTGRLTGVHTTAANLDIRIPYATDPAGNRLPDPELHPDSTLSMWPDNRIARDAHYLYRYDRYGRLTEKTDLIPEGGIRTDDERTHRYHYDSQHRLVHYTRTQYAEPLVESRYLYDPLGRRVAKRVWRRERDLTGWMSLSRKPQVTWYGWDGDRLTTIQNDRSRIQTIYQPGSFTPLIRVETATGELARTQRRSLADALQQSGGEDGGSVVFPPVLVQMLDRLESEILADRVSEESRRWLASCGLTVEQMQNQMDPVYTPARKIHLYHCDHRGLPLALISTEGATAWCAEYDEWGNLLNEENPHQLQQLIRLPGQQYDEESGLYYNRHRYYDPLQGRYITQDPIGLKGGWNLYGYQLNPISDIDPLGLSMWEDAKSGACTNGLCGTLSAMIGPDKFDSIDSTAYDALNKINSQSICEDKEFAGLICKDNSGRYFSTAPNRGERKGSYPFNSPCPNGTEKVSAYHTHGADSHGEYWDEIFSGKDEKIVKSKDNNIKSFYLGTPSGNFKAIDNHGKEITNRKGLPNVCRVHGNM

SEQ ID NO: 43 - protein, 1420 aa, Escherichia coli
MSGKPAARQGDMTRKGLDIVQGSAGVLIGAPTGVACSVCPKKKDSPNYGNPVNPVLGAKVLPGETDIALPGPLPFILSRAYSSYRTRTPAPVGVFGPGWKAPFDIRLQIRDEGLILNDSGGRSIHFEPLFPGEISYSRSESLWLARGGVAAQHSSQPLSALWQVLPEDVRLSPHVYLATNSLQGPWWILSWPERVPGADEVLPPEPPAYRVLTGVVDGFGRTLAFHRAAEGDVAGAVTGVTDGAGRRFHLVLNTQAQRAEVFRKQRATSLSSPAGPRSASSSLVFPDTLPAGTGYGTDNGIRLEAVWLTHDPAYPDEQPTAPLARYTYTAGGELRAVYDRSGTQVRGFTYDAEHAGRMVAHHYAGRPESCYRYDDTGRVTEQVNPEGLDYRFEYGESRVIITDSLNRREVLYTEGEGGLKRVVKKEHADGSITRSEYDEAGRLKAQTDAAGRRTEYSLHMASGAVTAVTGPDGRTVRYGYNSQRQVTSVTYPDGLRSSREYDEKGRLTAETSRSGETTRYSYDDPASELPTGIQDATGSTKQMAWSRYGQLLAFTDCSGYTTRYEYDRYGQQIAVHREEGISTYSSYNPRGQLVSQKDAQGRETRYEYSAAGDLTATISPDGKRSTIEYDKRGRPVSVTEGGLTRSMGYDAAGRITTLTNENGSQSTFLYDPVDRLTEQRGFDGRTQRYQYDLTGKLTQSEDEGLITLWHYDASDRITHRTVNGDPAEQWQYDEHGWLTTISHTSEGHRVAVHYGYDDKGRLTGERQTVENPETGEILWEHETGHAYSEQGLATRQEPDGLPPVEWLTYGSGYLAGMKLGGTPLVEYTRDRLHRETARSFGGAGSTAGYEQATAYTLTGQLQSRHLNLPQLDCDYTWNDNGQLVRISGPQECREYRYSGTGRLTGVHTTAANLDIDIPYATDPAGNRLPDPELHPDSTLTAWPDNRIAEDAHYVYRYDEYGRLAEKTDRIPEGVIRMHDERTHHYHYDSQHRLVFYTRIQHGEPQVESRYLYDPLGRRTGKRVWRRERDLTGWMSLSRKPEETWYGWDGDRLTTVQTQQTRIQTVYQPGSFTPLLRIETENGEHAKARHRILAEVLQEDTGVTLPAELAVMLGRLERELRQGIVSEESQQWLAQCGLTAEQMAAQLEAEYIPERKLHLYHCDHRGLPLALISPEGETAWQGEYDEWGNLLGEESAQHLQQSLRLPGQQYDEESGLYYNRNRYYDPLQGRYITQDPIGLRGEWNLYKYPLNPVRFIDSLGLKFHVNGDPSDFNQAVEYLKQDSQMKETIDFLSSSEETINIEYIEGTNVRFNSNNMAIYWNSRASLFCSTELNSKSQSPALGLGHEFAHAQYYLLDKKNFMALLSRTDKKYENKEEARVITIIESRAAKTLGECTRGAHSGLPFYRVDGPLQTMKITGTPE

SEQ ID NO: 44 - protein, 1425 aa, Escherichia coli
MSGKPAARQGDMTQYGGSIVQGSAGVRIGAPTGVACSVCPGGVTSGHPVNPLLGAKVLPGETDIALPAPLPFILSRTYSSYRTKTPAPVGSLGPGWKMPADIRLQLRDNTLILSDNGGRSLYFEHLFPGEDGYSRSESLWLVRGGVAKLDEGHRLAALWQALPEELRLSPHRYLATNSPQGPWWLLGWCERVPEADEVLPAPLPPYRVLTGLVDRFGRTQTFHREAAGEFSGEITGVTDGAGRHFRLVLTTQAQRAEEARQQAISGGTEPSAFPDTLSGYTEYGRDNGIRLSAVWLTHDPEYPENLPAAPLVRYGWTPRGELAVVYDRSGKQVRSFTYDDKYRGRMVAHRHTGRPEIRYRYDSDGRVTEQLNPAGLSYTYQYEKDRITITDSLNRREVLHTQGEGGLKRVVKKEHADGSVTQSQFDAVGRLRAQTDAAGRTTEYSPDVVTGLITRITTPDGRASAFYYNHHSQLTSATGPDGLEIRREYDEWGRLIQETAPDGDITRYRYDNPHSDLPCATEDATGSRKTMTWSRYGQLLSFTDCSGYVTRYDHDRFGQMTAVHREEGLSQYRAYDSRGQLIAVKDTQGHETRYEYNAAGDLTTVIAPDGSRNGTQYDAWGKAICTTQGGLTRSMEYDAAGRVIRLTSENGSHTTFRYDVLDRLIQETGFDGRTQRYHHGLTGKLIRSEDEGLVTHWHYDEADRLTHRTVKGETAERWQYDERGWLTDISHISEGHRVTVHYGYDEKGRLTGERQTVHHPQTEALLWQHETRHAYNAQGLANRCIPDSLPAVEWLTYGSGWLAGMKLGDTPLVDFTRDRLHRKTLRRFGRYELTTAYTPAGQLQSQHLNSLQYDRDYTWNDNGELIRISSPRQTRSYSYSDSGRLTGVHTTAANLDIRIPYATDPAGNRLPDPELHPDSTLSMWPDNRIARDAHYLYRYDRHGRLTEKTDLIPEGVIRTDDERTHRYHYDSQHRLVHYTRTQYAEPLVESRYLYDPLGRRVAKRVWRRERDLTGWMSLSRKPQVTWYGWDGDRLTTIQNDRSRIQTIYQPGSFTPLIRVETATGELAKTQRRSLADALQQSGGEDGGSVVFPPVLVQMLDRLESEILADRVSEESRRWLASCGLTVEQMQNQMDPVYTPARKIHLYHCDHRGLPLALISAEGATEWCAEYDEWGNLLNEENPHQLQQLIRLPGQQYDEESGLYYNRHRYYDPLQGRYITQDPIGLKGGWNFYQYPLNPVQYIDPLGLDLLSLPSPRQKPVSQSCTIDPITQQPVGRFIGDSKGNIMVEPVGGRTIPYPPSNPGSADTHTLYQNNSNAYRLNPIGHANNSTPHAHAHLPGTGSGMKGQGPSLDVNGRVVPWNSSAAHIGIRSLGTLSFFSSVLHMFTLRSCKEGTFGQCYCAMYVEMSTGSNQDEADIMCGMPEYF

SEQ ID NO: 45 - protein, 1548 aa, Datisca glomerata
MSDWDVLELDGDPTPGDPEAVRALATRLREQAERAESSTTRLRAIAANGGDLRMAGDYAPRFTEALAELPDELAKLARAYHGCGDALSTYATTLTEAKTRAGGALRQGLDAHGRYQAALRQVRTLLPPDREVALWPRAELSDGSISSATVGWESPDLAAQVRAAAQQGQVASADRLRARRLADDAAELRGNAAHTCAREIEDALAGSGIKNKPWYEKVWNAVSAPFRSWDSFVELCRDVAMVAGVVALFVSGPIGLALVGIALVAGATVFASTLAKYARGQASLGQLGLDALGLIPGARGVTSAAGLARAAAGLARGVTHGQGVKLVGAALRGAGTALATRGRNMMSVARWGLSNPRANGVEAVKRLVRLDPIDVATGDMVLTQTDAELPGVLPLPLSRTHVSSYRLGSWFGRSWASTLDQRIEVDDNGVYFATADGMTLVYAAVSDADGPVLPVEGPRWPLTRGADGTYAISDPWQGRTWHFTPLTPLTPPHGAAGEPRPSGGQRAAGGPVQWPLSALTDRNGNRIDFVYDGDDAPVEIAHSGGYRIRVDTWRHRVVALALLGDGGNDPGGNDPGGNDPDGSATVLVRFGYTEAGDLAEVVNSSGQPLHYDYDDDGRIVRWTDRNATEYRYAYDASGRCVATVGSGGCLTGQLRYDTERRTTTVVDSLGHATIYHRNEALQVESVTDPLGNISRYTWDRYDRKLTETDPLGRTVRCTYDAAGNLAEIARPDGGRTTARWNDLRLPVTLVEPDGDRWERSYDDRGNLTAVVDPAGARTLLAYDDRGRLTAVTDALGHTRRVETDAAGLPVAVTDPLGAVTAYERDAFGRVVAVTGPIGEMARFGWTVEGRLAWHTRPDGATERWTYDGEGNLVEHVDAAGLVTRTEVTHFDLPAARTGPDGARLEFSYDTELRLVAVTNPQGLVWRYDYDPAGNLARETDFNGRALAYGYDAAGQLVERTNGAGQTVRFTRDPLGNVIEKHSASGVTTFTYDAAGRVTRATNPDADCVFQRDALGRVLAETCNGRTLTSAYDVLGRRVRRVTPSGAASVWEYGPNDLPLSLRIAGRTLRFTHDEAGREVRRSLDTGVVLAQAWDVNDQLLSQTVTAGGPGTARQARLLQRRDYSYSPDGYVTEIDDMLAGLRRFDLDPARRVTAVHGANWSERYAYDTAGNITDASWPVPTQRDGRDGEHEAAQGGREYTGTLIRRAGSVRYEHDGQGRVTLRQHKRLSAKPRTWRYTWDADDRLTAVTTPDSQRWRYLYDPFGRRIAKQRAADSGTGDAGGVAERVDFTWDGAVLAEQSHVTAGDPTGRITTWDWEPGSFRPLTQSERRPSDGADQAWFDARFHAIVTDLVGTPTELIGPDGNLAWRNRTTLWGASPQPADGAVDCPLRFPGQYHDQETGAHYNYFRYYDPETARYDSNDPLGLAPAPNPHTYVPNPLGWLDPLGLAPYDVARMRHYTNVRGKEGILSSGVVRASDQNKVFLVPAKGKPLSPRDAEEYLGIARGRGRHVLEFDVPADRLSKDYNPTMNIHEWTVTGDIAVTDIKVVR

SEQ ID NO: 46 - protein, 3316 aa, Frankia sp. EuI1c
MTGRHRPASSRLLSFGLLSFGRRRWRRDARVRRVAPLLAVLLVVVGLVVLDAPAKPKAVPIADQNPFRGSDKLPGSSSGSAAGKVSLVPTSATQGTAKAGPATLKGKAPVVAGAVASTGATITPLKQVPFTPQKPSADEAARAASTPRGAQLGPSRPQAVTRPDASGEMKPQAGRVEVPGLRTASSEVFHNPDGTYTSEESMGADRFKDSKGNWVGIDTSLVAGDKGRLRAKSTQSGLEVAPKANDAELGSIDLGGGLSFGFGIAQAAGVAAKIDGSKATFASVRDQADVELGPTADGMKEVLVLRSAQAPTTWVYPLTLSGLTARLSDGGDVELADKAGTVRALIPHGWMADSRPTTADGFQAWSDGVTYSLITLANGQQALQMDLDKAWLTAPDRVFPVNVDPSVSTLLTGEDDTYVSSANPSANYSALADIKAGYYSPTNDIVHGYLSFPGSDPLTNATVTNAHVKIFNWFSASGCTAHPVSLRSVAFGWNGTNMTWPGATLGGEVANKSFADDGSSSCGGSWEFIGDYDTRLSNLVNTWTHDPTANFGLGLTTSDTDTQWLKSFYSNDCWCNPATPDSDYRPRLELEWTPYGASYSFPSGTPAWSVPPTTTAPGQITVRLTNTGQATWTAGAGYALSYHIFDATNTFELIHQGLQTPIPTTVASDQSVDVNASVDLSSLSSGNYTIRWDMEQTGTSWFSGQGVGELATPVSVAAGVNQSPYIVGVSPISGSEVPSTQPTLGVLALDPDNDPLTYQFQLCTGTDANSGTCQSSGWTSWPIWTPPTPLTWGQLYYWRVQVSDGTSQSLWSSPLVLEPVNYNATVGADYGANTYAPAVAGVNPLTQNFTTQVTDASVQGAGPALSVARTYNSKSTTDGLFGTGWTSAYDVTAGAATSGPGNVQVRNGDGRTTLFGRNGDGTYQPEHGYYSSLQASEPRVASFTAANSTSSLGATDTGETWQALAGTWGISNNSAYLASAGIFKSVAVVPAPADGTIQFSTPTTQSRLGIAFRVQDADNMWMLYENGTSLVLAKRSGGLETTVKTVTGVCCATTDTYGVRMVGSTLQMLRNGAVVGTATDTAFSTVTKAGLYAQSTGTGRIDGLTITPEGHRATFTGANSATSLGASDDGEAFTGLAGTWGISGNSAYLATAGGSGHNLTTVSGAADGTITFTEPVAQAGVGVAFRAADVDNYWRLVAQPASNSWQLVKRVAGVDIVVATAASGCCTAADVLSIITSGTSIAVLRNGTQILSTHDPALLFASRAGPYADAAGTGRIDTFTTTAATELTEKGGTASTFRSDGKLVATTDPAGNRVALAYDANSRLTTATNTTSGRALTFTWTTDNTHIAQVATPSVAANGGALTWKYSYTSGRLTGVTTPGLTTGGSTYSYSSSGQLNQITLPENTLDTKVGYNSDGTVAWREDGLGNRTTYAVTATSPNIVVRTTDPAGTNTDWTYSVYGQLLSKTGPTGTKTFTYNDDGFLAQATDENGNVTNYQTDGHGNVLARTVVRYSDASGTWPVTDYYDYYNGPPGDPRDDLIVAHRDGRSAAPTDDAYKTTYGYDPVGNLLSTTSPPTAAFPGGTTTSSSYTVGAETAVGGGTEPAGLLASTTDARGKVTTYGYDSKGDLRHDQDPAGLIHDYTTDEIGRRLTSKETSDTYPSGLTTTYTYTKLSQVATVTEPGVANPITSTTHTRVTTNTYDNNGNLTQAVVSDSTGGDTARTTTYTYDADDRPLSTTAASGTAAAATNAQTYDANGNVATTTDPNGTVTAYTYTPLNELATTTLKDFVDDPVAGTSPRDLVLESRAYDPAGRLASVTDALGRTTNYTYWLDGKLHQVTLTGYHNPDFATGDLSATTRNIVLEDHSYDGAGNETSTVTGGGLTTATASYDQAGNATGTALDPAGVHRTTALSYDANGDPTAIETGAAGTSTTERTEYGYDNASRLTSTTVFGDGVARYTTALTRDQRGYTTTLVDPRGYTPGAAFDPAFTTHVTTNAAGGVGQVTAPSVQVEENGNTASAATPTGTVGYDTFGEVTQSRDARNLTTTTTYDALGRPTQVSYPSYTPPGGSASTPSESFTYDDNGNVLTHVDTRGQTTTAVYDMRNRVVSVTDPQVDGLPAPGVSRAIYDDANNLVTTVDQVGAWLFYAYDDLDRPWATTSTERTPSATFSTYYGYDDAGDLNKILRPTNVGAGAAATADYNGAGELIATHDEAGKTTTYTYDLAGRLASGTDPLGRKTTYTYDRAGRQTGAAQFSNTNAQLRSLSIGYDAAGNVTSQTDPNGNTTTDAYDALDQLRSITVPVAAGSSITTSAGYDTAGNRTRLTDGNGNATITTFNSLGLPEKTIEPSTTAYPNLTDRTWTTSYDTGGLPVTEVEPGGVTRTSTYNALGQLIGESGTGTGVASASRTLAYDLAGNLTNEDSPSASEEFSYDDRDLHTGSHGTEGDASLQYNADGLLTSRGNGGLTTGYTYDTRGNLATVTGAGTPGTRTYSYDDADQLTSIDYATGSSGAVESYGYDQLGRTTSDTLTAPGGTLRSQTYGYDNNDNLTATTIAPAGVAGAGSQSYGYDQADRLTSWTSQAGSTTAYGWDAAGNRTSVGGVTATFDARNRLLNDGAASYTYTARGTLASTTAGSNTTTDTFNALDQLTSVASGSTTTTYEYDGLGRASWRNSSQAFTYDDLTNEPAFHDGTLYAYDPTGKLIGADTGSAGLATLTNPHGDTTAAFTTTGTLTDTRAYDPFGTPTTTGTSHLEIGYQGGWSDPTTSQLNADTRWYTPTTGTFTARDSTPLPWTGTAADNRYTYAAANPLLNSDPTGRRSGPSWETRVLRAAATELRSGEADEEAGEEGGGATSYAVSREAGYGLACAVFCPHNEPDANAGAALGAAVGTAGNDNGAKLGAAIGSAAQTTTKTKTSKSSQSASSTPTRTKTSKSSKPARSPARQQPTYPDPNDVVHGTLHVNPDANHGVGNNGTIPKPTDVPQTYSNPLDANLGPSTDETAGLQYTASDSDCHNAGLAHCIGDDPVNPPTQTGGAGSGQGTGQGGDGTPPPDEYLGDESQNSCAVGGQSFTASTEVLIADGTTKPISQIHPGDRVQATDPTTGKTAPQTVTNVWVNHDTDLLDLTIQTATGTSTIHTTEHHPIWNDTTHTWTDANELHPGDHLHTDNGTPATVTATVVIPASGDMWDLTIANTHTFYVVTTGTDILVHNASSCTSGSNPAARTGQQVHKDFSTILNGYGDVGYEGEFKLPSGLRPDGAFTDPATGVRVPVELKPDTRSQIRRGLGELRVYEQEMGVPSGSGQLWVYRVNPQTGAASFQRVR

SEQ ID NO: 47 - protein, 2294 aa, Geobacter metallireducens
MGGTRYLIVGILLMAVLSLCRASFADTVTYGYDDFGRLTAMTTVDATRLTRISYLYDNVGNFTNQTVTVGILVNMPDANLRNAVCSALGKNPSDPLTRDDLALLTTLSAAGKGISDLTGLEWAVNLTSADLRNNNITSTAPLAGLTKLTVLQLDGNPVATTAAVPAMGTVGLVLATLLLMLLTMSQRFRLPGRFIALLGLCFSLSVTTVNAADGPAGPGWLEVQGTPVTPQEADAFYQAKGVIQPLSAPLGSITPQSATTATPEIAALARSLKNDPRLIYEYVRNNVDYAPYFGSLKGATLTAIEGSGNDFDQASLMISLLRASGYTAQYVYGTMTIPVGGDPNQKDMQHWLGVDATSSVIGTVLANGGIPYSQSGTSFTVNRVWAQATIAGATYLFDPAFKPHQTITGIDLKTAMGYSTSGLLAAAGGTVGTDYVQSLNEAGLKSALDGYTLNLAAYIRANYPNAKTSEIIGGSAIVPQTLAAFPTSLDFATTVTATWTDIPDAYVHKVRIQHGKIDQTLNIPDLAGQKLSIVYRTGSITTASAVAAPATTEPQVNLAPLPTATTPVDGQLTITPAGPTDTTLPNIIVPGSYLDGSKTIVPMATGSANFGSIYPASAGASSTSMTWGPITNPNSVTVQIVVTLTSNPQGAYSITQYAGTNNVAPGASISPKVVFSNAGQTAGTKTGQLHIQWFYNGTPITGADSYYDLTGYVANAMSLGGYGLNAQAYMNTPYTGNARLSNNGSLPLAVTAKTLTGTGAARFQLVSGTAATTLAASTFQDIPVTYLADVHGTQTASINMGFTYDGMTYSATNYLPLQGQAIYKPDFTGSLGFNAGTPYLAYPVDGTAHLANAGSQPLTVTGFSITGTDAARFTITGGNAAGTIASGGHRDITIRYLANSVGTHSATLHITYTYDGIANSIDLNLVGQTLSTPVAQLWLDDTMLAEELEPVTGVDLSTMTISVMHQYTGSFADQSVNYTLTRGSTYAIVYDFGGSRLGKLLEKRERQMQAYRESGLADTSRQVLTESLNVIGQTWMRDTTLDANLLSQIGGVIDLRQHRFGIVAQETGYYIDVKAQVSTVSPIHGDTIARDAYFRTTGHLASAMEHGVLEQMQANSPAVSTVKLLQLNNAAGKKAFMVTSANYAAIKPQLANYSTDDLNSFQTSVTSGNTLILPENGKIPLQVWSGKGYIDFNMGGTSRHVGMIIGGGYNGGYGAIKAPVAVNTEMAHVNVNLSPQATIPKIGSVDPVDMATGFWMYSNTDLTLSGGAGGLSLRRSYNSGSNNIKDSLGYGWSHNYHLYVEPHSSTPFGLGQRQPVDAAALIVASVATLDVMNGTPDVKSWLTGALIGKWAMDTLTNNAAGCHLETDVLTFVKLPDGSFASPPGVTSTLVKNGSLYQVNERFGRTVTFDGSNNANAMTDADGNGVTFTYTGGKLSKVTDNFGHSLDFTYTGDLLTSVTDKAGRSVAYGYTGTDLTTYTDPEGKVWTYGYDTSHRILTLKNPRTVTTVTNVYDAFGQVQSQTMPRQTGTATYNLYFNGYRNIEEDGTGHQTIYHFDEQKHLLGVENTLGQRTTRYYDGQGHVVAETDPRGFSTGYLYDGNHNLTRVTDPFIRYTDTTYDSQFRLTDVTDPLGHTTHTDYDTKHHPVKTTVYPATGQSIYTQKSYYANGLVNTTTDGRGVITTLTQDTYGNPATSKTSTAPAITYVYDGIGRMTSLTDQEGAKTSFTYDKRSLPTGSTDPLTKNTSLTYYDDGTLWTKTDRNGKTTTFTYTPTGKTNSIAYAGGTSVTYTYDQDDNLTKMLDSLGTTTYGYDDANRLTSTTDPRGFAIGYDRDANGNISRITYPGNKTVSYTYDALNRIKTVTIDWLNKTATYTYDDAGRMLDLTHFNNTYTRYTHDNANRLTALENRLSNAGSPIATYAFTLDGNGNRTGVTQTVPIALNATASNTNFTMNLQKNRLAQAGSTSFTYDNEGQLATRTGDIYTFDDAHRLTNITGSVSYQYKYDGAGNRLEATRNGVTTRYIYDANGNLLAEADGTNAITRYYIYGNGLLAMVASGNQPYCYHFDATGHTVALTDAGANVVNRYAYTPFGAIGNQQETISQPFKYVGKYGVMSEPNGFYYMRARYYDASVGRFISEDPKGFDGGDVNLMVYVGNNPVMLIDPNGLSAFGKIWNLPNTLLGLAWGGIGMLGGAHASIGNNAIQFEKHPFMFGAITLGNTISYAKDFGPNTMLDNGTVGKHESQHTIQGEQLGPLYLPSNILGLAAGQIINGNTHGPANWNERGPQSTPPSPWGGYGK

SEQ ID NO: 48 - protein, 2427 aa, Kitasatospora seta
MAAVPSAEALAAKRARDTIWTPPNTPLGSQTKSVDGENLVPGRLPGPLEPEPADWTPGGPASVPAPGSADVTLGFDSAEAAAARKATGGAAPASDGAALRAGSLPVVIGAAKDAKSGAHRIRVELVDQAKSRAAHLDSPLIALTDTEPDTPPSGRTTKVSLDLKGIGAQTWADRARLVALPACALETPDRPECQQQTPVQSSVDLRSGLLTAEVILPAATEGTAPPTKSSLGSGTASGVVQAGLTTAAPAKAAPTVLAATAGASGSGGSFSATSLSPSAAWGAGSNVGNFTYSYPIQTPPSLGGTAPSVGLGYDSSAVDGKTSAQNSQSSWLGEGWGYEAGFIERGYKSCNTAGIANSSDMCWGGQNATLSLAGHSGTLVRDDTTGVWHLQSDDGTKIEQLTGAPNGLQNGEHWRITTTDGTQFYFGRNHLPGGDGTDPASNSAFKEPVYSPKSGDPCYNSSTATGSWCTMGWRWNLDYAVDVHGNLITYTYAQETNYYSRGAGQNSGSGTLTDYTRAGYLTQIAYGQRLSEQVTAKGAAKAAALITFTAAERCVPSGSITCTEAQRTTANASYWPDTPLDQVCASTGTCTRAGPTFFTTKRLASLTTQVLVSGAYRTVDTWTLTHSFKDPGDGNAKSLWLDSIQRTGTNGQTAVTMPPVTFTAVMKPNRVDGDLTLKDGTKVTVTPFNRPRLQQVTTETGGQINVVYTTSSDAAHPACSRLAGTMPAAADGNTLACAPVKWYLPGSSSPDPVDDWFNKYLISAVTEQDAISGTTLIKATNYTYNGDAAWHRNDAEFTDAKTRTWDGFRGYQSVTSTTGSAYPGEAPRTQQTATYLRGMDGDVKADGSTRSVQVANPLGGPALTDSPWLAGSSFATQTYDQAGGTVISANGSVAGGQQVTATHAQSGGMPALVARYPASQVTTTSKSKLSDGTWRTNTTVSTSDPAHANRPLSSDDKGDGTPGAELCSTNGYATGTNPMMLNILAERTVTKGACGTPVTSANTVSSARTLYDGKPYGQAGDLAESTSALTLDHYDTGGNPVYVHTAASTFDAYGRLTSVSEANGATYDAAGNQLTAPNLTPATTRTAYTPATGAIATTVTQTTPTGWTTTLTQDPGRAEALVSTDANGRATTQQYDGLGRLTAAWSPERATNLTPSQKFSYAVNGTTGPSVVTSQWLKEAGGYAYKNELYDGLGRLRQVQRTSDTYSGRLITDTVYDSHGWPVKTASPYYEKTTAPNSTVYLPQDSQVPAQTWVTFDGIGRTTRSAFVSYGQQQWATTTAYPGADRTDVTPPNGKYPTSTFTDGRNQVSALWQYRTATPTGNPADATVTTYTYDAANRPATRKDAAGNTWSYGYDLRGRQTTVTDPDTGTTTTAYDVNSRAVSTTDGKGNTLVVSYDLIGRKTGLYQGSIAPANQLAGWTYDTLPGGKGKPTSSTRYVGGAGGSAYTQAVTGYDAGYRPTGTSVTIPASEGKLAGTYTTGLTYNPVLGTLKQTDLPAIGAAPAESVMYTYNISGVLQKSYSDTYYVYDVQYDAFGRPVRTTTGDAGTQVVSTQLDKTDYTYNQAGDVTSVTDVQNGTATDAQCFTYDHLGRLTQAWTDTAGSTSTTSGTWTDTSGTVHNSGSSQSVPALGACANANGPASTGSPAKLSVGGPSPYWQSYGYDSTGNRTTLVQHDTTGNTTKDTTTTQTFGPAGSVNTATGAPNTGGGTGGPHALLTSSTTGPTGTQVTSYQYDQLGNTTAVTETSGTTTLAWNGEDKLASVTKTGQAQATSYLYDADGNQLIRRNPGKTTLNLGSDEVTLDTAANSLTDTRYYSAPGGISIARTTGPTGASALAYQASDPHGTANVQINVDAAQTTTRRPTDPFGNPRGTQPAPNTWAGDKGFVGGTKDDTTGLTNLGAREYQPTTGRFLNPDPLLDAGNPQQWNGYAYSDNDPVNSSDPSGLITNALADGDTYVARPAAFCVTMSCVEQTSGPGFWEDKRVGDAVFAAVVQATTQSNGNGSSQTKKEKGIWGQAWDWTKKNGGAILGALVEGAVFSTCFIGAGFAAPATGGITVIAGAAACGAVAGEAGALTTNILTPDADHSVDGITNDMVVGEITGAAVSAASEGASSLAKPAVRKLLGMEAEEGLEAAGRAATGPCNSFPAGVTVLLADGTTKPIEQIAQGDQVTATDPQTGTTQAEPVTDTIIGHDDTEFTDLTLTNDADPRAPPSEITSTTHHPYWNATTSRWTDAGDLKPGDHVRTPDGTELTVNTVYSYTTQPRTARNLTVADLHTYYVLAGNTPVLVHNTGPGCGEPGFVSDAANSLSGRRITTGQIFDASGNPIGPEITSGGGSLADRAQSYLADSPNIRNLPAKARYASADHVEAQYAVWMRENGVTDASVVINQNYVCGLPLGCQAAVPAILPRGSTMTVWYPGSGSPIVLRGVG

SEQ ID NO: 49 - protein, 2217 aa, Methanosarcina acetivorans
MFFMVLQVPIHTRRLLSIFMIIVLLTPNVYCLENTEASQDVNSEGSQVDSESYEENNKNIVESEEETSETISDLDSESVDDDTETVSEDTMLTATTVSEDEEPLRDAKAYLSPTLENENNYFDTSLFTGSFVYSYPIETLKGRTGLEPEVSLTYSSATGSKGTYGSLGIGWSLNENCIIRDTRYTPENTNDDRFILVLDGSTYKLVYVESDNSYHTETESFMKIEKSATSSNSFGDYWTLNMPDGTKYRFGYNIDSEQRNSVESRNYVSKWWLDLIEDVNGNKIKYTYLENPVSGEVGSTYPDSITYNDNHAVIDFEFTEKPRVFTIYEYGNKIIEKNLISSITVRNDETVLWKYDLDYETQQLKLHLKSITKTGLNNEEFPPTVFEYDSITEGWQESSSWTPPTSMSGDKGRRIADVNGDGLDDILKGYVDSDGDVYCSTWINTGDDWELNSSWTTPTYFRHYNHDGGARLADVNGDGLVDIIQHGFYISSAWLNTGTGWEQNNSWIPPLDFGWSSDYGVRVLDVNGDGLVDIIKGYKNDRGTIYYDAYLNTGEGWIQDNSWNPPTYFSYDNIDTGVRLTDLNGDDLVDIFKLRSSWLNTGSGWEQDNSWAPPISLDSDQGVVLVDVNGDGLTDILKSYYNDAGYTYDAWISTGNGWENDNSWNPPTLIASYGKDQGVRFADLNGDGLTDIIKAGYSDYCAWTNTNTESTENYKTQGLLKKIQHSTGGSTTIKYEPSTLFDNTGEDGVSDLTMSMWVTSSVTGDNGITGTGSVVSTTDYTYKNGMQYFDPPEEIEFRGFGEVTVENEYSIVKHFFHQDNVLKGIEHHTEVWDKNGNLYSSSDTEYTAQEIYPDVNLILLDSESKTRFDGLVQNPTSSAGWSYLTEYNEYDDYGNPLSITDHGDVNNAGDEKYYHFGYANAENPWILGKKTHEWVEDSDHVKKSESWYYYDETNDNSAISKGQLTKTVLWNNMGDNPNVLYDYDNYGNIIRITNPEGASKNIGYDENHLYPVYIENAFGQKECYEFNDLGRITKITDSNDISIAYIYDDLHRITKVLKVNDTLDSPSIEYTYYQDGVAPEKILTTTKECGSEENNYVINGSVFSNYKRITISPSSDGTLTDYQVKLDINYESEMQSDFDDLRFVDENGILLPYWIEEKVDSSYAKVWVKVPVIDGIDGATIKMYYDNSYVSSAENGDDVFEFFDDFESGVIDNAKWNEVGSPTIVDDNGDKVLKVTPSNEVNTFNKFSGTEYIVGGLMKFSSFGDYGPRMTLDVRRQNDQTILATCRIESYADGTGGTGTSIRYYPGSGSFITVAQARPSWSTGVWNRFSFSSTNSTQKLTINGLVISGTCENNLSGSINIHTWDSGNDIRLSYLYVRKFASSEPTVVLEEKNYVSTFDSTDSYDGFGQLIQKKYEGEGGWIIQNTAYNELGLVESAEIPHYSDQTGLSVTYEYDAAGRPTVITNTDSTTLTYDYNLDDTTITNQNGVDKTLTSDVFGNIVKVYEFNEGETYVTSYSYDALNNLIEITPGFNDPQAPPSVYFTYDSLGRKVAMDDSDMGSWTYEYDLNGNLINQTDSRGVSTILSYDDLDRVTAIDYPNDEDISFTYDLEFNGTLSRVTKGPASSSYDYDLRYRVESETLTIDGTPYTTSYDYDSMDRVTGITYPNGEAVSLTYNAQTLLESVDGVIDDLDYNARNQITRKEYSNGVITTYTYDSQKLLLDRIYSAGLQDLNYDFDNVGNVLEIADNTQNSVKTYGYDDLDRLVSADMSVNSVPTYQRDFTYDRYGSIRQVDNNGATVSSYGYSATPSHAPVTYNGNTLDYDANGNLVDDEDFIYVYNDANQLSEVRYSANNSLVEKYWYDANGQRIKKQNSDGEFTYYINKFYEIDNGISTSYFFRDDERVAKETSESMEWYLSDHIGSTSLMVNENGLEVERTDFPYGQVRSGGLEKYGFTGQENDADTGLMYYGARYYSPEYRVFVQPDTMLPDPYNPQALNRYSYVLNNPVKYTDPSGHVVDVLVDGGFLLMDLDDIRTGNADKWTYIGLGVDLVCAFVPGVTGGRLGVQALEETVTHADNVEDLFKLLDKTVDAEKKVDDVIDSGKVAKNSNQIYNVIKRADLPNTKITSSKLQHEWKHATDFGIKGNWNKANGDLYEKAIQNHINTAPEVYKSTYRQNQDVYVYLNKETGVGVYTDLSGNYIGAGNSVRNRLSIIQLMDLK

SEQ ID NO: 50 - protein, 1794 aa, Microbacterium testaceum
MSDVDLEVYGAPDLTYDFGLADAVASAANSAASAVEGQAGTRASYVTTAGQDFRGYFSELFAANAATAAGDARELASRLRDVSSFIGRLSDAAREENARRKRAREWKARVEARRSNWLDATWDDIFGEEPPPQGGEIEPPVFQATPVNASARQTPSAGGGGGGTSSARPENLRTFATGNANLDAALSAHPGRVSSAASDFMATCDFGGIDVSPVVTGFQTWLDANANDTAWANTIAQAFEDAGTNGGIGTVSDAALAASLAAAGVSATRQDLVIDPPTAWGGAPTTGFVNDPVNSATGNFLEPENDLPFPAATGLLSLTRMYNSLNDGDGVFGLGWSSILDTALLLSDDDARFVMADGRQIVFGRDGRDWARATGENYWLNRVRAAEFAARGLIGPDGLLVTDNTGAWWAFTTGGDWLGAGAGAGNVVAVVRDAAGAIVALEHSRDRRVDVEYADGLVASVTASDGRRVEYLYDEDRRLTAVTGPAGTRTYRWNEDDLIDQVVSAAGVIECTNVYDVQGRVREQVTEFGRHTRFTYLSGRVTEVADADGSNANTWIADRKGRLVGIIDTDGNRQSMAYDPNGNLVSVTDREGRITVHAYDTRGRRTRTVTPDGADITYGYDDHDRVTTVVTADGGIVTYDYPNDLERNPSRVTDPGGGVTELDWAAGLLRRVEDPEGVVVRFDYDAHGESVATRNADGAVAKLVRDATGRVTQAITPLGAVTRYVYTDAGVLASREDPDGAIWRYEHGPGGQITAIIDPLGARTELEYGPHGHLTRTTDPLGRSIDRSFDTFGNVTGVTLPDGAAWGFTHDALSRLREITDPAGGVWTREYDAVGDLVRTTDPTGVSAEATLSRTDATRTVQTAFEQTSVSYDSYGRPEKIQDAAGDASLITYDACGRAVEVLDADGGLTRIDRNLAGRVTAITTPAGRTTRYEYDHCGRPVAAIDGNDARTTLEYDADSRVTARVLPTGERVEIEYDEVGRVVRERVPGSGVSRFGYDKVGRLTFSHDTRFGIRRFSYDPAGQLVAATNGIGGVTRYAYDERGRVVSIADPAGGVTTRTYTHLDKVASQTDPLGRVTTADYDAAGRQIRQTSPDGTVTEWSYDDAGLESGLSVNGRVVTEIRRDARARTATIVDHTTAEPTTHTLRFTRLDRLAESTSDGRSTRWEYDADGARTRLVTPDGVTVDYTRDAAGHLTRIDHSRLGAVHYTRDAFGRILEARAGDGLQTWEYQDGFPVAHTRTDADGATLTRITRDNEGRITGIDGPDGTTRYTHDDAGQLRSAVGDGHASAWEYDTAGRLIHETRDDVERAFAYDTAGQLLTLTAPDGDTTYAYDGQGRRTRETTPAGSTQYTWDDRGWIRAITTHTPDGERRTELRVNALGELAEVDGTPLTWDAGSYAATPLTVGDTDVFHAPGAITGIGDTWTTGGWRSTRTTGTDDPWQALTAAQALGGGAVGISPAGGLEVAGLEWMGARAYDPTTRGFLSTDPITAPAGAAWSANPYSFAGNDPLHATDPLGLQPVTDEQLTAYANAHQGALATAGNAIGEWWNENWEYVAGGAMVIAGGVMIATGVGGPIGAALIGAGADTIIQKATTGEVNWGQVALTGAFGLIPGAGAAGGLLARTGANAAQGAVENTAQYLISGQPITPGGLLSNAATGATMSAVTAGALSRVPAGSAINRLDEEVPQFVDLASPARREHILDGDLTGGGHRWPGAEGKTPFPQGWSDDKIMHEISDVATDPSLTWRQQTGAPGADFTKNGRPVRYAVEGERDGVPLRVIIEPSGDGIISGFPLR

SEQ ID NO: 51 - protein, 1397 aa, Pantoea ananatis
MFEAARLGDDIGHSHALAGMIAGTIVGGLIAAAGGIAAGALMIAGIGASCLGVGVLLVGLSIGVGYLTGELATAARDGIADAGAASMTPKGKITTGSPNVFINSKPAAMATNSIVACKDDGPQQMAEGSSRVYINGLPASRIDDRTTCDAKVMTGSDNVYIGGEPEQTLPIQPEVPEWVYKASDLTLLFAGLAGGVGGAAGKVGALGKLLSKIPGINKIARVACRAGALMTGVAAAGILARPVDIVSGQKFLSGDDELDFVLPSRLPLRWQRYWRSGNPGDSVLGRGWNLFWETRLERYQDGLVWRAPSGDYVSFPLVPKGQRTYCEAEKHWLEHHRDDSWSLYDISGERWHFMPLRDDAPSLPLCLTEPCGNEIQFDWNSDHTLAALTDSAGQRVTCRYANNRLAGAWLDDDICLVSYAYDDIGQLVTVTGRGGSVRRRFQWCDGLMVAHEDMNGLLSEYRWQEIDGLPRVVAFRHSGGEQLDFEYDFDNGIRRARRDDGVEAHWLIDDDDHVARFTDFDGRQTMLVYCAGELCDVIMPGGAMRCSNWDRYGRMTQEIDPVGRRTTYHWFRMTDRVIRTDYPDLSATQAAYDLNVRLLTETDALNNVTTYHYPDDTELLPDSITDATGGVVKLEWNRQGLLTQRTDCSGSVTTFSYDRFGQLVRSVDAEGHVTQREWNDKGQLCAIIHPDGSRETLHWNTQGQLSAWRDPLETEVRWTYNALGLPVSLTDRIGRTRRWHYDARGNLLRLENGNGGDYRFTCDPLGRPLSEIRPDKTSRNMEWNARGFLIGLQENGQPANDGGIARRWQRFSYDDSGLITQRTTQHAEYHYRRHRSGQLASLVRTPTSDGMALGIEDDEIAFTYDVAGQLLTEAGINGKLDYEWDALGNLTHLTLPGEQQLAWLHYGSGHVSAIRFNQQLVSEFTRDRLHREIRRSQGAREQARQYDSLGRRTMQRSELHSEVVLPEKAILERAFRYSARSELESVSDTLRGDIIYGYDDEGRLLKHYEARQGHSTSHFTYDNADNLAANDDALHALPVTDNRVHHWQNLFMKYDDWGNLVSRRSGLHEQHFTYDAENRLISAKGNGPDGGFTAHYHYDALGRRTCKVVSTQHDRKEVRFLWQGYRLLQEQQDNGQCQTYVYDPNEAWSPLARIDHMAAGGRGDVLWFNTDINGAPLEVTDERGNIRWSGQYGSFGEVRRQTEGFTRLAKQSALPHQPLRYAGQYADSETGLHYNLFRYYDPQVGRFTVQDPIGLEGGWNLYQYAPNPLSWVDPLGLSNCGAPNKKTSYEGISRRDAFRQAKRDAGIPMNQHPSSITRPDLLDGSGKKILDSTGQPIKTRQYEFVDKRGQSVFLQEHSLGHTKATSGHGAEPHFNLRPLDNLNTGSVPGTHGHYNFP

SEQ ID NO: 52 - protein, 1663 aa, Parachlamydia acanthamoebae
MKHIFLFLFLTLCCRIFSFQTSLSTPEHIENAPVHLYLHHAINVINGTLYEAETDLATSGASSLTLKRIYFPQERATSPWEHGWQFNYPHYQSSSNDKKVNNQLEYDAQGRLIKIHSNHDEQITFSYTQDHPLQCHVKSHDGQNLKYSYASHTNSKNQIFHLLEEAKLPSGLVWRYQYQEHPLEKKMLLIHKEGSEGYFVQTEYYDQEEIDSIPSKESPLRNFSCGKIKCQWQPHGIDKTPVKTVSLVYSPGKTEVFDALNNQTTYHYNGYGQITAVEYYLKDDVQDPILYRTEKYYWDSNLKIQAPIGKTIEDSQGNVWLCQRYLYNEEGSLIQETLYGNLSGHCPSPIILDEHGIPKNPAIEHYSSYYTYKDNNLVQIKGDNGSSLSFVYDNHLLKGKFYHDQERIRIREFYDYNADDILIKTITDDGSSYDPDDLKHVSERQITYIHLFQSGPFVGLTDSIEEKYLDLSDQTEHLIKRIQHFYSTNHKLIRRDIFNSHQNFSFSEVQNYDHLGNLTYVATPSWTQEYKFDLYGNILLNKKTLPSGDSEEVVNHYDFRNRLIRQELFSSARLSKMALFSYDLQGNKISEDDGYGNATSFEYDGLNRLVKTISPAVENEQGEKIHPVLTYSYDIFDHITSMVSPKGEMTSTTYNIRGKPLKITYPDLSEESFEYSLDGSLKRWNMKNGCSIVYERDFLGRVTKASLLDAQSVLIQGTQAIYSTSNLKTVIAPSGVVIDHLYDPSGKQIGQIQHTADTSVHTICHYDATEQLVSTEEWIAPNKEYYTKTIYHQKGSVVESQQGKILYETKTDTSTKKPLNEKRWVNSLGQNVLLLEETDKNGNLISLLYDALGRMVALTKTSSSGELLFKQEYRYDLVGNKIWQKSQNDKNSIIHEWEYGPGNHLLKHIEGSGLACQRTTYYIYDKDKLVKTIKPNGVELMAIYNGRGLIEHLFSSDGTIDYSYAYDSANRITQLIDHRLKQTTKRTYSSTGLLTDEELGNGLQMIHEYDAKGRKTKVILPDDSAVIYTYNPLFLKKVQRVSPSGKICYQHTYSFDIHGQLETSELIQGLGTIHYQYNKDGRCEEINSPFFKEKLFYDTADNLKATIITHNNETLNAQYSYDCLDQLIQEQSSYFEHSYLFDSLFQCQEKDHIAYQYDDLFQLLDTSEQSFEYDPNGNCTAQIQSQQHISYTYDALDRLIQLKTDHQYLIEYQYDCFNRRLSKLIKVFNVSENEWQTHHQIHFLYDEDREIGEIDPEGNIQKLRILGQGMGAEIGAAIALEIHDNVYAPICDHRGSITCLVDTETAEIVESYQYSAFGEEQIYNAKNEQVPLSPSANPWRFSSKYREDETQLIFFGKRFYDPKNGRWLTPDPLRADSPNFYTYVNNNPLNHVDLYGLFSLKTAFQKYANFTQWLALPFGSSSLKRCLKKCSEHLIARPFFNLTGFYIYPSETGTYGHGEFSDQVRVTMINGILNTYEDFSSTLRIVSETHGGENIHYVFRPTQGLFPDLLQAFMSKIGYLSPHVRQLARTWKDMIQEMGGTENGGLIIHYAHSLGGTDTFTAAQLLTPEEKRMLRIFTIGSPTLFSNQGFENVLNYVSKRDGVSLFDPVGYIKGIFSQTSNVSYVGTLKGIPLIDHLIGWVTYTDLLKILGIKFLQSYPSPDY

SEQ ID NO: 53 - protein, 1854 aa, Bacterium Ellin514
MKSIKLAAIGGLIFLCAILFYIPHRALGQLTISTPTFPTSNTIQLTLSGTQTNLLYNIQYTPALVSVPFSTIATGAQGQTVFNFTMGSSNANFFRAFGMTNASGPLIVSTPAFSPGGGAYSMPQNVIISCSTPLVSIYYTTNGATPTTSDIYIPSGGTVFLSSIVTLKAKAFRSGYVDSGVASATYQINSPPLVSAGPQQIITSASTTLQGYVTDDGLPTGHTLTKTWSKVSGPGTVTFGNASQTNTTATFGADGVYVLQLVGGDSQYNVTNNVTIAVNPTVSVSLNTPADGSIYTVPTNFTLSATAACGSGSVTQVAFYANSTLIGTSTTPPYLFDWKSVSAGTLALTAVAYTTDPANTGLASSPVTVTVNWPTNVGQVTFASTELQVPAAGLPITINRLYDTRFATNGSFGYNGKLDYEQVNIQTSGPLSTGWLGKRSGLTYYVADTAQHVVTVSLSPSEQYSFIPQIIFVLSGTSTINASQVPTCYNAYKVKLAFIPVGQGQLTVSGPSPSRVGMDDGLSGWTVPLTVTRYDSFGFPTSNYEPAFSDFTFTAPDGTKYNFDGNGNLSQHTDRNGNYLQYGYGGIVHSSGKQVLFDRDPTSGNVTAIYDPNSQDGFGGITGPAAVTYGYDALGNLTNVSRLVDRVATNYNTTAYAYTNASFSNNVTAITDPRGIVASRYEYDASGRLTKQYDAFGHFTIFSYDTVTHRQVVVDRLGNTTVQNFTASGLLASLQDAAGGVTAYAYDQQGRKIAQTNALGQVTTYSYDSNDNVTGVTTPIGSSSSATYNSFGEPLVAIDDLGNGTTNVYDVNGNLLLVTNALNIVTAYGYDSQGNTITETNALGLPEQVLVTNAYDQFGNLTNTTTLNVQLSVLNSVGYTYDANGNKLTQTTTRTASGSTQTILMQWNYDAANRITATVDTLNNTNFTVYNGIGKQAQTVDALNHTNLLYYDANGLLTNATYADGLSETIAYDAEQRIVASTDLCGRATTYTYDAVGHLIQTTYPDGSYVASSYDLAGQFKYSTMTTPSAGMLPSTTITTAKYGYDSAGRRIAMTNALYQVTRFAYDANGNQTNIVDALNHTNSLVYDALNRQSAMIYSDGTRESYGFDGLARKTAVTNQAGIVTLFGFDALGHLTAVTNNFGGAAQAVTKYVYDEVGNLVQQIDALNHTNLFDYDNLGRRTKQTLPGNQISLFSYDAVGNLIRETNFNGVVITNQYDALNRLTNKSSAGGYKITFAYSPTGQRTNMVDASGTNSYTYDSRGRLLTKITPQGTLTYTYDGYGNLATIQSSTAGGTLLSYGYDILNRLTNVVDRFTNSTVYNFDVVGNLQTVQLPNKVTNSYTYDTLNRLTNLTAKSSGGTVASFAYKLALAGNRTNLTEALNGVNRTNSWSYDARFRLTNETITASAAPTGTISSKYDSAGNRTNRTSSVAGVGSQTFNFNANDQISTDVYDSNGNTRTNGANVFFYDAENRLTNATVGGTNITVIYDGDGNRVRKIIGTTTNFYLVDDFNPTGYAQVLEEKTGTNLTRIYTYGLTLISQRDTVTRFFGYDGNGNTRYLTDTSAAISDTYVYDAYGVLVANSGTSTNFYRYSGEQFDPNLGLYYLRARYMNPDTGRFWTRDSFEGNPEDPKSLHRYTYGEGDPIDNRDPSGHDIGGVLTAINISGMLAAMSSPVTTRASAIVGGSGSVGTSRPLTQGEITLAQSMFGGKIDYTKVNIYHKKQNPLHPKETLITPDGNIYSNPKGNTYSTDYSAAALPNLSLIVTSELFIHEMTHVWQFQTGVHVMASALYRKYEYDYSKLGTIKFTEYGVEQQATIVEDYFLLKNGYTKNDKNGKPVQMPSLQTYQTVTSPYFP

SEQ ID NO: 54 - protein, 1352 aa, Pelobacter propionicus
MKPAKLNNTVVFTIVFFISICGVCFADPLTITGPDAPSDGSQYSATGGSAPYYWCITKGSITHNGVVTVSGQCGSATITVWDSSGETARKTIRMAGTSRWVQTDYKTCPSFTCAGSGCPCTGGCSWVWGCIFSSYYPVEISGNIKKVGSAWTCASSNGRGCLVWTGPPPPGVSCSGSQLQLVSSITTYEWKCQDGTNGPESSCSSPPVPLKKPKDLGAGTANATCTESAANLKSGNYYHSQSIVARPESLSLDLSYNSLETGDTPLGRGWTHSFNLSLATTSSGLRVKLADGDFLDFVLSGTTYLPASTSTDTSNIVKTTEGSYVRTFRDGLTQTFNASGQLTAISDANGNTTTLAYSGNDLATVTDSTSRNLTIGSSDGRIIAIQDPAGRMTSFAYSGNLLTSVTDPAGTSWRFVYDEYGRMIRKTDPGNNTSENGYDAAGRNISSTDAEGRTKTISYNATGSSSVTEKDGSVWTHAYDPTLNVPTATTDPLGNTVRRSYDAKGNLLSITDPDGNTTRYTYDAANNPLTVTDPLGNTTSYTYDSLGRVLTITDPDGRITINSYDERGNLLRSVDPTGGAYLFAYDAAGNLTSVTDPRGNRVGYVYDTYNTIAAITDQNGKTIRFSHDISGNLLTMKDPDGKITTYSYDALNRLVAITDPLGTTTKFTYDNLGNRTAVTDGNGNLTSYTYNFRNKPLTIRDALGSTTTLAYGGCGSCGGGGNDKLTSLTDANNNLTGYEYDQLGRLARETDPLGNVTGYGYDSRDNLTARTDANGSTATYAYDANNRLLRKTYPDGSVESFSYDARGNILTAANKHISYAFSYDANNRMLSSTGSNNGTLKYEYDPAGNRTTMVTPEGERISYRYDAANHLTAIVSPRGTFDITYNDLGRRTKLSYPNGATISYRYDNSERLVKLEHKTRHGRTIDSFSYTLDRVGNRLSTTEANATTNYGYDAIYRLLYAQQSRRHNSRDNEQYSYDPVGNRLIGPHQQTGYSYGTGNQLLKNDQASFTYDKNGNLAERSLDNDQHGHHGHQSTSWKYTFDYENRLVKAENGAVNVSFAYDPFGRRIEKRTEITGPGERGHDVEEGITRYLYDGMNLIRETRERHRHAGRSETISYLHGPNIDEPLAAMSDHRSWYYHADGLGSIVALTDRHGTVVQEYNYDSFGNPDQRGENIDQPFSYTGREWDRETGLYYYRARYYDPKIGRFIQKDPISFAGGDVNLYAYVLNNPINRLDPFGLWNSKTFPTNISNYANSALYWPGSKYQPIGPFGKICGAEGTVEATWIPDITPEACRKHDECYDKCAKKCAGYDCKKICDSKLFRSNPPYGTATKLYGKDAYDAAKRKYGCNKCN

SEQ ID NO: 55 - protein, 2965 aa, Prevotella denticola
MSKYFAGTLADSLSVGRAELKVPRGSMERAKILSITPLRKGELPHLPAGMVNVTADRSHPTVAINSKDSIAGYRFLPHGEHFVHSLASITVPYDSTLIPQGYTAEDIHTYYYDELKAQWVMLRHKALDKGRELVMAETSHFTDVINGIIKVPESPETQNYVPTGISELKAAAPSAGITAVSAPTANQSGTASLSYPFELPKGRADMQPSVGLQYSSDGSSSYVGYGWSLPLQSIDIETRWGVPRFDADKESESYLLMGSKLNDRTYRTTDAPARTKDKRFYPLVEGGFAKIIRKGDSPQNYIWEVTSKDGTVSYFGGVDGMIDEGAVLKDGNGNILRWALCKTQDTHGNFISYKYFKKGNNLYPDTYRYTGSKDGEGAYSVQFAFKSDARKDVVKSGRLGVLQTDDALLDRVEVKYNSELLRAYALHYKEGVFSKTLLESIEQLDSKNNHVATQTFSYYNDITKRIFSDTPVIYTAEKDNYGRLVKFYIGNFDERLSLLGGGSAKGNTVGGGVMVGAGWGPASVNAGGSYSYTKTNNEGRIALVDINGDGMPDKVWKGADGRLHYRLNQNKDLRHPSFGDKMTITGIGSFTGGTTTSNSWNANVATGFGPASIGYAVNKTTDQSKSKTYFQDFNADGLIDIAQNGTVYFNHSNGKDVSFSSTSTNTGNPITGNAASIDSTFIPDYKAIRDSLEREFPLHDAVRLWRAPYAGTVKVTGAVNKPSAQGDGVSLSMQHNDIVLWKDTLLQFGSLTVPTKTLSVRPGDYLLFRVNARCSGIGDVVEWDPDIVYTSIAVDAYAGEDLKHYRNSSDYVPGEMSTAPLAIDGTVFYEGGFNKQKTSDDVVLSVVKTDKTGTQTEINRLLLPADTVLTAKFEGNFHSSVVDSATVNFIIKTNSPINWQHISWTPVFHSDTTKYTLAPQRLMFNKNIVAAKDTLIHVVASDSTWGDRLVFVPDLKVSRSSDKDTAPATVHLTLKDETGSLLYHKDYTMAGNNHLQGDSTVVNGISLIPHLSAKKIQVSFSVLNELDNAPIARLHVLRDSILYKVGTDGKKHESGRRLVRVDSISASVFSSFNRFDHGPLYKGWGLFAWNGNEKGEPIKIDEIRASDHNDYIKDGKIDEEAVEKNTLDINKQKFFTMAYSPTTGKYVSATDSVYIKVTMMRASRLGEDEIVVDSINYNLNGEGLSAPVQMTESKSKGKTYSLGFSMGVSLGVNRSNTKQESYTTVSAMDLNGDSYPDWIRENDGKIRVQLTHQIGTLGDGQDYDVEPSMSYGESENTGGDAGLSMDPNSYKLPNFKEQLRKATASFAKSVASLQQTKRLDKNAEGASFSGNVSEGACSASGNFSSGTSESVRDWGDLNGDGLPDMISKGQVRYNLGYSFTKAMPSGINAVEHSSNNNYGDGMGVCIPILGLFNISAGQNDTGSLTSGKGAFHDINGDGLPDFVEQDGNGDLKVTLNTGSGFATPKDLQKKSELSGNMGSSVAIYASTAYTIRIPLPFGFVINITPSIQGSHSESINRTTAALMDIDGDGLPDLVYSDSENSMKVRRNLTGRTNLLKGVTLPFGGHVAVEYKQTEPSYNMPGRRWVMASVETTGGYAENGATRMRNEFEYEGGYRDRRERDFYGFEKVITKQIDTQNGNAVYRKQVAEYGHHRDFYMHDLITSETLYDAAGHKLQETENKYTLTAQAKTDVFFPALVSVKQTIYDNNGSGSMSTTMHNTYDAYGNLASYKETATNYELDADITYHDLQAKYIVSVPKHIAVKDKGGKVYRERSTQINGNGDITSITMHNGTKPSVYDMTYDAYGNLASLTKPENHKGQRMRYDYTYDDVLHMFVTNVKDAYGYTSSTVYDYKWAVPLETSDLNGNKMRYTYDGMGRPSTILAPKELESGRPYTLKFEYHSAERYARTLHYSPEGDIETYTFADSLMRAVQTKQTGVVWTGGGNQKVSIVSGRAVVDAFGRTIKAFYPTTESYGSIGTYNTATGDPQATTEFDVYDRTTKVVLPDGATTTTAYGIVSHDGEPMLETKVTDALGRNAESYTDEKGRNRETVQHASGDNIAVKYDYDAVGQVTTVHHPNDKTTTYEYDLLGHKLKVNHPDAGEVTCTYDAAGNLLTKLTAELKKRISADAPITYTYDYERLSEVLYPKNLFNRVTYTYGKPGEKYNRAGRLVLVEDASGGEAYYYGNQGEVVKTVRSVMVSTADVRTYIYGATYDSWNRVRTMTYPDGEVVTYAYNAAGQIASVKSNKQGKEETIVEKVGYDKDGHTIYTKLGNGIETTYTYDKQRERLQEMNLTTVGTSIMHNKYQYDAVDNILGITNAVDPTRGNTNGDKKLGGAFKHSYAYDDLNRLVYASGKAKQASYSMQMTFGRMSEPLTKIQKVDSTKTAQSYDFTYKYEDSNHPTAPTQIGHEHYTYDANGNPTLVENDSLNTERRMYWDEDNRLMVLSDNGKTSRYTYNAAGERIIKSHGDLEGVYVNGAPQGITFHETEDYTIYPAPIITVTKNRFTKHYFIGDKRVASKLGVGKFSNVYGISGNNVTAGQKDYAARMMQIEKQREEYYKSRETPPGIPTMKGATADPDNTHRGYNDIIGDLGDHSVPEGWVQRPKFNEKGDVPGPPIQWQKPEDPDNAQPGYGYIPTDTTNTEEIFFYHSDHLGSTSYITDAKANITQFDAYLPYGELLVDEHNSSEDMPYKFNGKELDQETGLYYYGTRYMNPVTSLWYGVDRFAEKYPQLSAYNICANNPMNTIDFHGDSITAVLITNGTAGIERIKYSYSAGENGEYGFRNSNGELYSGTDNFINSLTSALNELRTGGDVGNALVSELINSTNSVEIAQGKANRADVKGTYILWNPNLTTGGLNEYGTEYRPAYIGLGHEMAHIQDTWRGTIDQSTWVTVNGINIPNSEKYSTHIENQLRAEHNIPLRTHYGIDASSGQRKGLESTRIIWNRFSMFYNRKVKVNAYFSVSTPFYY

SEQ ID NO: 56 - protein, 3077 aa, Prevotella denticola
MKYSTHSLLLPFLLLAGTVLNSCNGGSRPAGQADVTTDTASSVRGDCTSRQAAPLRKQVKDSIQGSSVKSSSKGVVRNDKENRVDTHKLDRKSARLFADLGRRTVSKFFTNSDSDTLNVGRAQLGVPREAMEKGKVLSITPLRKGELPTLPTGMVNVTGSCDTLMARTDTVSGYRFLPHGNHFVHHLASIAVPYDSTLIPKGYTVDDIHTYYYDELHQRWTMLQSKGIDTKREVAMAETSHFTDVINGIIKVPESPETQNYVPTGISELKAADPAAGIQQIEAPSANQNGTATLSYPFEVPAGRNDIGVSAGLQYSSEGGSSFAGYGWSLPVQSIDIETRWGVPRFDSRYESESYLLMGQQLSDRLYRRTDSLSRQTDKQFYPMTEGGFSRIIRKGNSPKNYYWEVTGKDGTVYSYGGHGGHASDATSLADTKGNRIRWALDRVTDVHGNFAAFHYMKSGNNLYPERYTWTGFGETEGLYSIEFNWNTGNVHRVDYVRSGRLGVLQTDSLLLGSVEVKNNGQQLRSYTIHYEKGPFGKTLLKSIDQNDSKGIVVAAQSFNYYNDVKKGLYADSITTYTAGIDNYGKLVKTKIGHFDEHLSLLGGASSKGNTIGGGIMVGAGWGPATASAGASYSHTNSSNEGRVTLVDINGDGMPDKVWKGSDGKLHYRLNMNKALSHPVFGKEQALVGVNSFSSGKATSYTLSANVATGFGPANMGYAISKTKDQNKTKVYFQDFNSDGLVDIAVNGIVYFNHSDGKDVTFAPASTATGNPIPSIAGVNVAPAFKVDYKTVRDSLEREFPLHDVVRVWRAPYSGTVSVMSHVEKHSPEGDGVSLSMQFNSDVLWKDTLLQSGSVTLPAITRSVKPGDVFVFRVGARYSGIGDDVIWDPEITYTSIKTDKYAGEDLKRYRSSEDYISGAYSTAALSETAVNRFEGTFNKQKTSDDIILAIIKTDKDGNQLVMDSLLLKADTVISHGSFSGNLTATAGEEATVNFIIRTASPINWKHIDWRPVFYADTMKYVLSPQCLMFSKNISLCPDTVIGRNVSIQGPVWGKALTLVPELSVQRTSNKDTAPATVYMTIKDDHGSLLYRKELTLGSSNQLTGSTIRVADGSVLAQKMSAGKIQVTYSILNELENATAKLKIFRDSVVSPATAGSPAVLRPVRVSTVNASVYSSFNRFDYGQLYKGWGSFAWNGTAKNVAIPKDKMKIPETNEYYHDGKVNESAVEANEMDINRQLFFTLSYLPEKKYFVSATDSAYVGSVVMRPSRLGEDDIIVDTVDYNIQGGGLAAPVLLTESKSKGKTYNMGFSLGASLGVNKSNTSQQSYNIISAMDLNGDGYPDWLNDNDGKVVAQLTQPTGILGKGSLQYDVENAATDGDASNIGGDIGLSSDKSAYSFKDFKEKMAVAKAAFAQHTTTKQIMKQRAAEGNSASHSGKVAEFSCGASGNFSSGTSETVRGWEDLNGDGLPDMVTDGTVRYGLGYDFTPATASSLTQLESTKNSNFGDGLGITVPVLGLFSVNIGQNDTESLTSTRSQLSDVNGDGLPDLLQLDEKGNLKATLNTGSGFMSGSTSLGQSNISDNLGSSVAVYASTAYTYTIPLPFGFTISITPSVQGSHSESISRTTAAVMDMDGDGLPDLVYSDSENHLYVRRNLTGRTNLLRSVTLPFGGHIHIGYEQTTPSYDLPGRRWVMSSVETTGGYKENGAIRSRNTFEYSGGYRDRRERDFYGFKQVRTNQIDTENGDRLYRYSVQTYGKNRDYYAHGLVTSEYLYTADGKKLQGSLYDYDLKTLAAGSNTADAVVFPALKTLVQSNFDAANGDSLAVTVSNTYDDYGNLQGYKETTTGYSLEADINYHKIADKYIVSVPSHITVSSGGRTYRERSTKVDGNGEITEIMLHNGDKPSVYNMTYDGYGNITRMTKPENYNHQRMFYAYTYDDRYHSLVTSVKDAYGYSSSTAYDGLWNAPSVTTDLNGQKMEYTYDALGRQQTIRAPYEIESGQPFTIRFEYFPAERKAHTIHYSKEGNIDTYTFADSLMRAVQTKQTGVVWSGGSNQKVSIVSGRAVIDAFGRNIAAYYPMTESYGNIGTYNHATGDLQAKTEYDAHDRTMSVTLADGSVTRTAYSIGSHDGEPMLQTTVTDALGRHAESYTDAKGRNRETVQHARGEDITVKYSYDPVGQVMTVQHPNGRETKYAYDLLGRKLMVNHPDAGETDMTYDAAGNLLTKLTAELRKSISDKGYISYTYDFERLHEVLYPENLFNRVTYTYGKAGDKYNRAGRLALVEDASGGEAYYYGRQGEVTKTVRTVMASVADIRTYVYGATYDSWNRVQTMTYPDGEVVTYHYNAAGQVERLTSNKQGRQSVIVDRIGYDKEGHTVYTKLGNGTETTYTYDKQRERLQMMNLTADGQTVMENRYRYDAVDNILGITNAADPTSLTKLNRAKLGGRSAHTYEYDELNRLVHASGRAKRASYDMVMSFGRMSEPLTKVQKVDSTTTAKSYDFAYKYEDSNHPTAPTQIGHDHYTYDANGNPVLVTNDSTNTTREMYWDEDNRLMVLSDNGKTSRYTYNAAGERIMKSYGTMEGVYINGAPQGITFHETDNFTLYPASIISINKNRFTKHYFIGDKRVASRIGTGLFNNVYGRNGSYVTAGQQDYAERMNQIQRQKEAYYKQQGIAPGVPTMKGAYGDPENTKRGYNSIIDTLGNHDVPQGWIQTPHPNTTTGTNPGPPISWNDPSNPDDPQAGYGYIPNDTTREETFFYHSDHLGSTSYITDDHANITQYDAYLPYGELLVDEHSSSEDLPYKFNGKQFDNETGLYYYGARYMNPVASIWYGVDVFQENKADVASYLYCFGNPINLTDPDGNWERDRHGNLIAQKGDNAVTYAKYTGISNKESLKILLANGITINSKGVLSLKVGDVIKNNGFSRSQNILKNESTGNDIPNNSNQTLTYGKYKFNINAAVRTLNKNANSHSLGKCAKYVRLALEGGGFNTAGHPVDAKNYNHFLRVRGWQVVSTSQGFQPLKGDIAVFRDFQGDKRYHSAGHIQMFNGNRWISDFRQNGFWAGGDYRRHQPSFVILRFGRKE

SEQ ID NO: 57 - protein, 3314 aa, Prevotella pallens
MKQTLTLALVATIVTVSAIAVAQYQQDDSLAAQEKGTENIYMVSSGKVQAMPGQLLGKKKKGNKISKGELPREEHSEKHGNDVPAGLGSSTSFATPNSGIVGIPDGRVSDNPEDNLFEITLAKVPSNSRVWLVYDLKGVSSASGVSKSINDRPGVGGYLTALSKEWKTVREEISPSWVKAGKNTILFTLPSDASYSYSVRNVRIETSPLEKIQESIVFSEHPTAYGSLAYVHGFIRGKADGITISGQKITVRNGEFEGVVPVSTGQLSLTASVSGKSVNKTLSVARNSKADFSRAFVSAGTAVGKQFLAHQSDSLVIAGNTLSVAKGEISKTGKYTITALRETDIPALDYGMTNVTARDEGYRFLPHGEHFAGKGATVKIKYDRTRIPSGFTEDDINTYYFDKETKHWVALERVKVDKASACVVSKTTHFTDMINGVIKAPESPQTDGFTPTMMNDIKAADPTSKINLITPPTANNRGSANLQYAFEMPPARNGMAPSLGIQYSSEGGSGWLGEGWNLSVPSITLDTRWGVPRYDTSKETETYLMSGSMLSTMGDDGKMGVAHRGEKMNRKADRQFYTRQGGDFSRIIRKGNSPTDYTWEVTDKQGIKYIYGGEGAVLKGTITDASGQSREVITEWKLKRVEETHGDYIEYVYETADEPVRGGLVAKAIYLKEVRAGNSGQAPHTVVVLEGSKQKRLKNNNARYGFLTSSNRLLEKLTVNFQGSTLRSYAFTYSEGAFNKDVLTGVKQLDDKGTEVSYQNFDYYDDVQAAKGYVPFKEKQETWNTHNDHLGAGFLNPLQFVSKAFSDKPSALGGTTSFSLSGSFYAGIGPMDGDKWKGNTIGASYGYSLDKSNGVSTLVDINGDGLPDKVFRKGGALYYRPQIPTSQNSEVLYGEDVRIVGVSGFSKITSSTHNGGAKATVGYQLFTAEVGVDFSSTKTKTTEYLSDINGDGLVDLVFNKKVYFNHIEFDKQGKAIPVFTLSSADTPSPIIYSGKLDASVIKVDPAEQEELIKSSPMEDMVRVWQAPKDGIISISGTVSLITPTGEYDTDEYAHADGVRVAIQKGRTELWNKKITKGDATAYNATAQNITVKKGDRIYFRVQSGTEETSNGAFDNVKWAPVITYTGAAETLPGGLSTTVYQPQEGAIYDASTLTNVAESASLNLSGKFTKPVTTDDVTLKIIASNSETDSIGNKNPTYQRKVIYTRTFAWKEAFNGEIQQTIPNPDGLTNLNFEISSSSNVDWSKIKWTPQIETIGKDGSRQRTAGATHYVLFADMVSEGKPVVLASNVSTLTVTPSITMLPPTANGMVTMTVKTVDKLLGKKTYTFSGGSLLGDPLIITGISAGKIWIDYSYSGNISGQTVTSAATVSGIGTVLAGFYAQTENKGFGTMYRGWGGFVYNASEGRYGKPIDESLLKLPDSKDAKINPLTMPFTPIGTDQMTFARWIGQNEFIYLTADAMGTARLGEQQVILTNPLEGSTETAALTGDCLQGTGATAVTLVSTSKSTVKQGGSMGITYNEAGGTSTTDVTMTDMNGDGYPDIIAGGTIQYTNTQGGLSGEKYSGMGKTTGKHSSKAWGAGGKPVASGVALLDMMTPYKGGSTGTQMNTGLKKALNNLRTSFLAKISISGNIPENTEDAVETFMDINGDGLPDKILTDRRVRLNLGYSFTDPIAWDIDRLQGGKTRSYNISIGAGDTIFAKKHITEDKKSIVKASGSISGGVGLVSSRGVEEYDLMDINSDGLPDKVWMTDDKVFVALNKGDGFTDGILWKGTSLLSENISTAESVNGAFTYTIFTPMPTPVIKICLNPGTSTGHSINRTTYALQDVDGDGYLDIVESDKESELKVTRSAIGRTNMLKSVTNSLGGTFTLDYEHSTPTYGLPGGKWVMSSVTIDDGIRDDGPMMKTMFAYSDGQKDRHEREFLGFGKVVTKNIDTEQGESAVYRQAVQLYDVSTYYAQGNELGTSVEDAKGNKYTETRNEYDGYYLTANGDKYTFTKQTKLCSDRASAFVPLRYTANKQYEGQATGITTSEAWNEYYLTGYHGELKSYKFSDKGKLGADGSGKFDYQTAIQYAHNDNKHIFGLPTNVTVTGGDGKTYHQVSATYDLNYADHITQIKQQLGSGEAVSDYTYDAYGNIIKTTLPANSKGQRMWYTYRYEPVMNMYVERIDDAFGYRSEAANFDYRYGMALRRMDLNHFYYETDIDNLGRVKAVRGPNELATGVPYIIAFDYQPKATFGTNGITVPAYAVTKHYDIQHPSDDMETVTFVDGFGHPVQVKKDGVVTTASKGSAPKDETVMIVSGRNVYDAFGRVAKAYYPVTEAVGNKTTFNKAFDNVSPTVTVYDVLDRAMKVTLPDNAETKTEYSTDAGSNALVTTVTDALGNRQATYTDGSGKTVKTEQLSGPDGIITTSFEYDGIDRLVKVTDTEGNVTTSVYDMGDRRTEVNHPASGITTFTYDALGNVLTKQTANLKKEGKTINYEYDYGRLTAINYPDHPENNVKYHYGGINSSYNRIGRLMLREDGSGAIEYYYGKMGEVLKTVRTLIVPNQAVATYVTQWKYDSHNRLLEMIYPDEEKVTYGYNLGGQVDHVRGYKSYGYDYVNKIGYDKFEQRTYLKYCNGAETFYSYDPARRRLQNLVVNAKAGTIMDNAYSYDAVSNVLGIKNNAPLPQSGKAGGQMSHSYTYDPLYRLASATGTYKGTDNKSASYTLSMGYDNMHRITSKKQHLSQTGVQFDGTLNAGYELAYTYGKDAGRKFQLDNVRDINYRTEETPTESTNINNGHKYTYDANGNLVYINTSRVKKDGKEDEKATEQKYRWDEENRLLAADENGFVSNYWYDADGERTVKTSGENEAIYVNSEFSGGNTGTARFSLYVSPYLVAGQGGKYTKHIYVGSQRIVSKLGDLASYGADPRRIPYAGNEADGLTINYKDKYNQQLQSIKDNYKTFDLPYNGKDNDDYVNGQGFCCNDGTPEAAQARAMARTRAANGNFKPNDDYEKMQFYYHPDHLGSSSYITNLDGEVAQHIEYVPFGEVFIEERNNTWNTPYLFNAKEFDEETGLYYYGARYYEPRLSLWISVDPISNYDPRNNENYLDGEHNLGVYNTFNLAPYGYCYQNPIRLIDPNGKQVDAVDFVPFLGSGRDIYRGFRDGDILTGAIGVGGLIADVFTLGSGSVVTGGIKAGVKAGVKAGVKAGVKAGVKTAVKQEIKQAAKTETKVAAKALTQASKQGVKSASELGIKDGMKTTSTKALELGQEFLGKGYREVGPDRYVSADGKRVFRMGDNDILGKHGGGPHVNFETLKPNPNKPGKMMVDQNYHVFITE

SEQ ID NO: 58 - protein, 3057 aa, Prevotella pallens
MKYSTHSLLLPFLLLAGIILNSCNGGSSRSAKETVISDSTSTDTVSSVQKDSISRKATSLHTQVKDSVQNSSVKRFSKEVVRNQKGNRVDTHKPNRKSARLFADLDKRTVSKFFANSDSDTLNVGRAQLAVPREAMEKGKVLSITPLRKGELPTLPTGMVNVTGGCDTLMARTDTVSGYRFLPHGNHFVHHLASISVPYDSTLIPNGYTVDDIHTYYYDELHQRWTMLQSKGIDTKREVAMAETSHFTDVINGIIKVPESPETQNYVPTGISELKAADPAAGIQQIEAPSANQNGTATLSYPFEVPAGRNDIGVSAGLQYSSEGGSSFVGYGWSLPVQSIDIETRWGVPRFEDQYESESYLLMGQQLSDRLYRRTDSLARQADKQFYPMTEGGFSRIIRKGNSPKNYYWEVTGKDGTVYSYGGHGGHVSDATSLTDTKGNRIKWALDRVTDVHGNFAAFHYMKSGNNLYPERYTWTGFGETEGLYSIEFDIDSTATDRKDVTSSGRLGIMQKDKGLLRKVIVKNNGQQLRSYTLNYEEGPFGKILLKSIDQNDSRDGKVATQSFDYYNDLKNGLFSSKAELWKAEGEDYEAFLSHSVRGCDDNLSLLGGGASKSHTTGWGTMVGIGFAAGTVNVGPSFSNSKSSNSGKVAFVDIDGDGLPDKLFKRGNQLFYRKNMSADGKNLLFGKTILVSGVNSFSDGNSTTHSFNADAAVEVGISSKLKASAGISYTHSKEQDKTTTYLYDFNSDGLTDIAINGQVYFNHIVDGKPVFSPASNVTANPIIGEGAPIDKHFIPDYKVIRDSLEKEYPLNDAVRMWCAPFAGKVNIQSTIKKLSNQGDGIIYSIQHESDGFMVRDSLLQAGSKTNNLNCDVKVGDRIFFRLQSRYDGEDDKVLWNPIITYVSLPVGKDRYLSEDLKTYNSKTDYIEGENNVAIFNRTGKVTLHAPYMKGKTSDDVTLIVTRLDHHGETIVKRLKLPADSVVNGSYDYTDNINEKDSVSFFFEITTTSPVDWTKVQWAGSYNYEDDQESVRFVASRRMFNKPVSITGSKVLKQGVTVLNRKYRPKLFIVPTLSVVREDKKNDTDTATVYLTLHDQNGLPVLHHTCRLNTSNTLKGDTIVVTDTTLIKRLNTGKVTATFAISNELAKSTYAKVSFLRDSLSYQSATSTVVTAVQRVLVDTLEACVFSGYNSVDYGRLYRGWGQFAYNGNKAYATQPIEVSALTIDRDKYKDIAEHYKSTHDGNQLAKSLTPVNEQRFFVMGYDANKRMYVGGSEHVFISLDTICSSRIGEDAIIIDSVHYAKNAGELSAPVLMSESKSNGYGVSGGVSYAGLSGSKSTQTSYSKVALMDINGNGYPDWLEEVDGNIVTQYTNATGTLGAGRMQLNVNRPKFKASSSTIGADASLSKRASAKNALAISINPKPQDDETQSGGEGRNSSNGNAISSVSVSASGNFTSGTSHTESDWTDLNGDGLPDMLFGDKVKFGLGYDFTNEENSGVTSLESSENSTWGAGLGTSIEVLGNADISFGVNGTKTTTKYNVSFIDVNGDGLPDMVTRNADKFTIMLNTGSGFIPYSEEQQGRFNESLATSVSQYGNFAVSIPIHILFLKLRFTAKVTKSWSSGVSRTSAALRDIDGDGRPDLIISDGGKQLIVYRNLTGRTNLLRSVTLPFGGHININYEQTTPSYDMPGRRWVMSSVETTGGYKENGAVRSRNTFEYSGGYRDRRERDFYGFKQVRTNQIDTENGDRLYRYSVQTYGKNRDYYAHELVTSEYLYTADGKKLQGTVYDYDLKTLAVGHNTTDAVVFPALKTLVQSNFDEASGDSLSVAVSNTYDDYGNLQGYKETTTGYSLEANINYHKIADKYIVGVPSHITVSSGGKTYRERSTKVDGNGEITEIILHNGDKPSVYNMTYDGYGNITRMTKPENYNHQRMFYAYTYDDRYHSLVTSVKDAYGYSSSTAYDGLWNAPSVTTDLNGQKMEYTYDALGRQQTIRAPYEIESGQPFTIRFEYFPAERKAHTIHYSKDGNIDTYTFADSLMRAVQTKQTGVVWSGGSNQKVSIVSGRAVIDAFGRNITAYYPMTESYGNIGTYNHATGDLQAKTEYDTHDRTTSVTLADGSVTRTAYTIGSHDGEPMLQTMVTDALGRHAESYTDAKGRNRETVQHARGEDITVKYNYDPVGQVLTVQHPNGKETKYSYDLLGRKLMVNHPDAGETDMTYDAAGNLLTKLTAELRKSISDKGYISYTYDFERLHEVLYPENLFNRVTYTYGKAGDKYNRAGRLALVEDASGGEAYYYGRQGEVTKTVRTVMASVADIRTYVYGATYDSWNRVQTMTYPDGEVVTYHYNAAGQVERLTSNKQGRQSVIVDRIGYDKEGHTVYTKLGNGTETTYTYDKQRERLQVMNLTADGQTVMENRYRYDAVDNILGITNAANPTSLTKLNKAKLGGRSSHTYEYDELNRLIHASGKAKRASYDMVMSFGRMSEPLTKVQKVDSTTTAKSYNFAYKYEDSNHPTAPTQIGHDHYTYDANGNPTLVTNDSTNTTREMYWDEDNRLMVLSDNGKTSRYTYNAAGERIMKSYGTMEGVYINGAPQGITFHETDNFTLYPASILSVNKNRFTKHYFIGDKRIASRIGTGMFNNVYGHNGSYVTAGQQDYAERMNQIQTQKEAYYKKVGVAPGVPTEKGAYGDPENTGVGYNAVLTELGNHDVPQGWIQTPRHNTTPNTNPGPPVSWNDPSNPDDPQAGYGYIPNDTTREETFFYHSDHLGSTSYITDDHTNITQYDAYLPYGELLVDEHSSSEDMPYKFNGKELDEETGLYYYGARYMDPKISMWLGVDPLMEKYTNVSGYVFCHSNPIVRIDRDGCADYFSISGKFIRSDKSKDKNIYIRTSSGNVLLSKYNFKRNLRAMMRITYHYAKEVGLEGKAKSIGVKSMKSNPEGELAITTYDNRIRVSTVNGHFKKSMDQIYNFRSTLAHEGFHIDTPNGVDEEVLVIMKEMSRKEFGKTTRSFKDNTAGYLQKELEKLYAVSGRNFYKVIGKAQKMLNKYGAKSSYEFIEGGNKIHF

SEQ ID NO: 59 - protein, 3091 aa, Prevotella salivae
MKYSTHSLLLPFLLLAGIILNSCNGGSNRSAKETVTSDSLSSDTVSSVQKDSTSRKATSLRTQVKNSVQNSSVKRFSKEVVRNQKLNCVATHKANRKSVRLFADLGKRTVSKFFANSDSDTLNVGRAQLAVPREAMEKGKVLSITPLRKGELPTLPTGMVNVTGGCDTLMARTDTVSGYRFLPHGNHFVHHLASISVPYDSMLIPKGYTVDDIHTYYYDELHQRWTMLQSKGIDTKREVAMAETSHFTDVINGIIKVPEIPETQNYVPTGISELKAADPAAGIQQIEAPSANQNGTATLSYPFEVPAGRNDIGVSAGLQYSSEGGSSFVGYGWSLPVQSIDIETRWGVPRFDDKSETESYLLMGQQLSDRLYRRTDSLARQADKQFYPMTEGGFSRIIRKGNSPKNYYWEVTGKDGTVYSYGGHGGHVSDATSLTDTKGNRIKWALDRVTDVHGNFAAFHYMKSGNNLYPERYTWTGFGETEGLYSIEFDIDSIATDRKDVTSSGRLGIMQKDKGLLRKVTVKNNGQQLRSYTLNYEEGPFGKILLKSIEQHDSRDGKVATQSFDYYNDLRNGLFSSKAEVWKAEGEDYEAFLSHSVRGCDDNLSLLGGGASKSHTTGYGTMVGIGFAAGTVNIGPSISNSKSSNSGKIAFVDIDGDGLPDKLFKRGDKLYYRKNMSADGKNLLFGKTILISGVNSFSDGNSTSRSLNADAAVEVGLIGKLKASVGISYTHSKDQDKTTTYLYDFNSDGLTDIAVNGQVYFNHIVDGKPVFSPASSVTANPIIGEGAPIDKHFIPDYKVIRDSLEKEYPLNDAVRMWYAPFNGRVNIQSTIKKLSNQGDGIIYSIQHEGNGFMVRDSLLQAGSKTNNLNCDVKAGDRIFFRLQSRYDGEDDKVLWNPIITYISLPVGKDRYLSEDLKAYNSKADYIEGENNVAIFNRSGKVTLHAPYRKEKTTDDVTLIVTRLDHHGETIVKRLKLPADSIVNGSYDYTGNIDEKDSVSYFFEITTTSPVDWTKVQWTGNYNYEDDQENVRFVASRRMFNKPVSIAESKVLKQGVTALNRKYRPKLFIVPALSVVRKDKKNDTDTATVYLTLHDQNGLPVLHHTCRLNTSNTLQADTIVVTDTTLIKRLNTGKVTATFAISNELAKSTYAKVSFLRDSLSYQSATSTVVTAEQRVLVDTLEACVFSGYNSVDYGRLYRGWGQFAYNGNKAYASQPIEVSALTIDRDKYKDIAEHYKSTHDGNQLAKSLTPVNEQRFFVMGYDTNKRMYIGGSEHVFISLDTICSSRIGEDAIIIDSVHYAKNAGELSAPVLMSESKSNGYGVSGGISYAGLSGSKSTQTSYSKVALMDINGNGYPDWLEEVDGSIVTQYTKATGTLGEDRMKLNVSRPRFKASSSTVGANGSLSKQASAKNALAISINPKPQDDQTPGGSDTHNSSNGNAISSVSVSASGNFTSGTSHTESDWIDLNGDGLPDMLFDDKVKFGLGYNFTNEESSGVTSLESSENSTWGAGLGTSIGVLGNADISFGVNGTKTTTKYNVSFIDVNGDGLPDKITRSGEKFTIMLNTGSGFIPYSEEQQGRFNESLATSVSQYGNFSVSIPIHILFLKLRITAKATKSWSSGVSFTSAALRDIDGDGRPDLIISDGAKQLVVYRNLTGRTNMLRSVTLPFGGHININYEQTTPSYDLPGRRWVMSSVETTGGYKENGAVRSRNTFEYSGGYRDRRERDFYGFKQVRTNQIDTENGDRLYRYSVQAYGKNRDYYAHGLVTSEYLYTADGKKLQGSLYDYDLKTLAVGHNTADAVVFPALKTLVQSNFDVNSGDSLAVAVNNTYDDYGNLQGYKETTTGYSLEANINYHKIADKYIVGVPSHITVSSGGKTYRERSTKVDGNGEITEIILHNGDKPSVYNMTYDGYGNITRMTKPENYNHQRMFYAYTYDDRYHSLVTSVKDAYGYSSSTAYDGLWNAPSVTTDLNGQKMEYTYDALGRQQTIRAPYEIESGQPFTIRFEYFPAERKAHTIHYSKEGNIDTYTFADSLMRAVQTKQTGVVWSGGSNQKVSIVSGRAVIDAFGRNITAYYPMTESYGNIGTYNHATGDLQAKTEYDTHDRTTSVTLADGSVTRTAYSIGSHEGEPMLQTTVTDALGRHAESYTDAKGRNRETVQHARSEDITVKYSYDPVGQVMMVQHPNGKETKYAYDLLGRKLMVNHPDAGETDMTYDAAGNLLTKLTAELRKSISDKGYISYTYDFERLHEVLYPENLFNRVTYTYGKAGDKYNRAGRLALVEDASGGEAYYYGKQGEVTKTVRTVMASVADIRTYVYGATYDSWNRVQTMTYPDGEVVTYHYNAAGQVESMTSNKQGRQSVIVDRIGYDKEGHTVYTKLGNGTETTYTYDKQRERLQVMNLTADGQTVMENRYQYDAVDNILGITNAANPTSLTKLNKAKLGGRSSHTYEYDDLNRLIHANGKAKSASYDMVMSFGRMSEPLTKVQKVDSTTTAKSYNFAYKYEDSNHPTAPTQIGHDHYTYDANGNPTLVTNDSANTTREMYWDEDNRLMVLSDNGKTSRYTYNAAGERIMKSYGTMEGVYINGAPQGITFHETDNFTLYPASILSVNKTRFTKHYFIGDKRVASRIGTGLFNNVYGRNGSYVTAGQQDYAERMNQIQKQKEAYYKQQGIAPGVPTMKGAYGDPENTGVGYNAVLTELGNHDVPQGWVQTPKPNTTPNTNPGPPVSWNDPSNPDDPQAGYGYIPNDTTKEETFFYHSDHLGSTSYITDDKANITQYDAYLPYGELLVDEHSSSEDLPYKFNGKQFDEETGLYYYGARYLNPMASIWYGVDPLAEKYVSTGCYVYCIDNPIRLIDPDGTHWVEDNKKRIVWRESIKNKQQAAVAGLIYRGKSYQRFFVNNQTYAVTREQYTPDRRLIISKAPKYRMDFSGKVVTAKQLTGRNLNTSRNAPYGIQGKAYLNAVFSDGTIHTAATFEFNSGPYANGPTPNNSYEALGAVPTNESGMLNNGRTGWKVLLPNYNGRSGLRVHPDTNSPGTKGCIGIVGCYEELKNLGNFFNNYIGPSGRHRMIFNFNIKGNPNYGNEGRHNSRLAQ

SEQ ID NO: 60 - protein, 3065 aa, Prevotella sp.
MKRLTHITLTTVIMLLSLASCNDGRRTSPAIDVLGEETPHATKPKRQDTDKDTVTSTPQKGTGGTVVTHTIQGAEASKALSRLRNFRHRTVSKLFARDVADSLSVGRAELRVPRGSMERSKMLSVTPLDKGELPQLPAGMVNVTGDRNTSVSVSLKDGVAGYRLLPHGEHFVHEPATITVPYDSTLIPEGYTADDIHTYYYDELQGRWTMLRHKALDKDREVLMAETSHFTDVINGIIKVPESPETQNYVPTGISELKAADPAAGIATVSAPTPNQNGTASLGYTFELPKGRAGMQPSVGLQYSSDGGSSYVGYGWSLPVQSVDIETRWGVPRFDPNNESESYLLMGAKLGDRTYRTAEPPARKPNKRFHPLVEGGFARIIRRGDSPTNYTWEVTAKDGTTSYFGGIEGKIVDNAVIKDGDGNIVRWALYRTVDTHGNFVSYTYEHRDSTLYPKVYRYTGHGNEEGAYAVNFKYISGTRKDAMKSGRLRILQTDDALLERVEVSFNGEPIRGYALHHREGPFAKTLLDSIVQLDAKGARVAAQGFDYYDDVKGGMFGKAESWTSEADNKHEHLPLLQKAINGFSNELSMLGGGYSKGKTFGGGLFVGFGVSVATVNVGASYIQSKNENFGKVALIDIDGDGLPDKVFQARDGLCYRKNLSGETGNLIFAKSRMVKGIGEFSRGTSSNKTLNANAAVELPFVSPGVSYSQTWDKTETKIYMSDFNNDGLVDIANNGTVWFNRIGTDGLPTFVPSTKETPNPIIGRSAEIDSTFIPDYKAIRDSLEKESPLHDVVRVWRAPFSGTIHIASVVNKSTTYGDGIIYSVQKEENVLRRDSILNTGMRKDSLTTSVKAGERLFFRLQSRYSGAADSVAWSQRVRYSQIVGGNATYLGQDLSHYDATSDFLEGMTTGISLPKDGRVEIKAPYRKGRTEDHVTLVVRRKDLHGEHILMEKKLLAGTSVEDTFEDAFDVLAKDSVQLTFEMLTDAPLEWRNMSWKPTLRYVSTQDTLRVIPFRKMYNKPVLVRASRNVRKDLAKNQKYDPGVILVHKFKVKRQDRKNDTDTATVNVNFNKEDGTLLFKRKYTLTKGDSIKVDSLAIVDATLLEELCKGKTLATFSVDNELRSVAMAKVEVLRDSLVFKKDSITQETVLDHKERVLVDTVVCSVFSGYNSLNFGHLYRGWGQFGYNGNREYANRPIETSALTIDTDGYKSIAENYDKSHKKEDLAGLTEPSKQRFFVMGYNAMRKVYVGATDSAYVGASFQCSSRMGESEIRVDSVQYASGEGLSAPILQSKSSGGGVSATGSGPLKFGISGSKSWQKSHTGVAAMDINGDGYPDWIDEGNSRIRTQYTSQTGTLSQLSVKTDIPMPEFSSGANTLGISNDGAIAVSIGNRNRSEAGRTTSNSSPGDVSSMSNTNENPNKATTPTSNSTGQCEGQNASDGNAVSSLSVSASGNFSQGNSKTTRDWLDWNGDGLPDMVEGNTVRYNLGYGFTMHMPRGCQDMDATSNTTWGAGLGTKITILGNAEITGGFNGTKTTTHTDCSYADLNGDGMPDKIIRDDDKVKVAINTGTGFVDEAQDIQGSAGKNLATSVSLYGSGAFSFRVYLLFLKLSITPHITAAWSTGVSRTESALLDIDGDGLPDFVESAGPDALVVRRNLTGRTNLLRSVTLPFGGHVRVEYRQTLPSFAMPGRRWVMSAVETSGGYAENGATRMRNEFAYEGGYRDRRERDFFGFAKVVTRQLDTQKDNAVYRTQVSEYGHNRNLYMHDLVTAETLYDAQGNKLQGTLNTYEAVRQRDDSTSVFPALVSIRQTVYDNTGQGSMSTTVHNTYDAYGNLASYKETATDYELRADIAYHELRESHIVALPRHIAVKDKAGKVYRERSTEVDGKGDITRITMHNGQLPSVYDMAYDAYGNLAALTKPANHKGQRMRYEYAYDGVLHQLVTGVKDAYGYASSTDYDCRWGAPLETRDINGNHMRYAYDDAGRPTAIIGPKELAAGKPYTVRFEYHPAGRWARTLHYAPEGDVETRTFADSLMRAVQTKRTGVVWKGGAAHKVSIVSGRTVQDAFGRTLRAYWPTEEGFGSMGLYNKGVGDLQAVTEYDAYDRPTKVTLPDGAATTTAYAIVDHDGEPMLETRITDALGRHAESYTDEKGRNRETVQHAGGEDVRVSYGYDAVGQVLTVHHPNGKTTAYEYDLLGHKLKVNHPDAGEVTCTYDAAGNLLTKLTAELKKTISDKAAITYTYDYERLSEVLYPKNLFNRVTYTYGKPGAKYNRAGRLVLVEDASGGEAYYYGNQGEVVKTVRSVMVSQADVRTYVHAATYDSHNRVRTMTYPDGEVVTYGYDAAGQVTSLRSTKQGKEETIVAQVGYDKDGHTIYTRMGNGTESTYAYDRQRERLQGMLLTANGDSIMQTQYKYDPVDNILGLTNVITPKAPKKPKGFGGSGRTDGMGGPDAGKEKKEKPLGGAFSHAYAYDELNRLVKASGKAKGIGYAMDMSFGLMGEPLTKVQRTDSGSVAGSYALAYEYGDADHPTAPSQIGHERYTYDANGNPTLVEDDSLNTERRMAWDEENRLTALSDNGKTSRYTYNAAGERIVKSHGYLEGVYVNGAPQGLTFHETEDYTIYPAPILSVTRQRFTKHYFIGDRRVASKIGAGIFQNAYGHGANVVTAGQKDYQMRMMQIERQREDYYRKLGTPPGVPTMKGATAEPENTHEGYNTIIRELGDHSVPDGWIQRPKRNAVPGTPPGPPVQWDKAEDPDDVQPGYGYVPADTTHEDIFYYHTDHLGSTSYITDAKANIAQFDAYLPYGELLVDEHSSTEEMPYKFNGKELDEETGLYYYGARYYDPRVSLWMNIDPMYEKFPNFSSYIYCINNPVKLIDPDGRQTQEPDSWKTISPVIPKEKFIGWGDPSVKDNYNCFALSKKQLNVMGYTVGGASVSSNLYTYNENRGVNRVDTHKAISYIKSALNQGVPVLIGVDTHAGSPNSDKTTDHYLVVVGMGHDKKGNYLQVYDNATSITKDGTNPENKLYYNSKTGKISGRIPNIYSQNSQRPYTVSQVRTSKALKRKKTRK

SEQ ID NO: 61 - protein, 1568 aa, Salmonella enterica
MGEAFWAAREGDALLHTSFLADLVGSALEFAINAVIDFAALAVVALATGATVATLGCSAVLLVGTVVGATMLLSGAGEKISKACEDIANSLFPPKIEGYILTGSGDTRINSKRAARAAATALSRHDVETLDAQAQAEAEEEKRRQDAKSMWDVAGEYLDAVKGRAENMAKGVVSVVSRMGSAEGWASLGNDALAEAGDMLSDTGHFISEMWQPTVATAYPGSDPKQDDKIDCHKHPSSFTQFMAQKLQALTDDPVGTVLGAMNTFDVLEAGFQAASALIGSVSNLFKGDDEPPAAEYIAEGTRDVRINSQPAARSGVRCTCEAKVVDEPENGVHVSGDVRIGGPLLVVRDIKSGKSQITLVTTIALTFMQPGRASAKSACFMMGLGINMMVQKAGSALNRPVNAATGAKYLAGDDDVDFSLPGHFPLEWQRTYSSRDERTEGMFGRGWSVLYEVCLERTPDNPDENCMTYVSPMGRRIDLQAVEPGSGFYSPGEGLAVRRSEQGHWLISSDDGVYRLFEADPFSPQRRRLKMLGDRNSNCQHLTYDNHGRLVEISGDRQRPCIRLHYELAAHPQRVTRIFRHYPEGEPELLRRYRYDEAGRLNGVVDNAGQYQREFAYDDNDCMTMHREPGGERYYYSWAWFEGPDDAAWRVTGHHTDSGEQYRLDWNLAERSLCVTDSLGRTRCHWWDAQGLVTAYRDEAGQMTTFRWSDEERLLLGMTDAQGGKWRYVYDRLGHLTETHDPLGRVEQTQWHPVWHQPETEVDAAGAAWRYEYDERGNLQAVSDPLHQRTVYGYDRHGQVVRITDARGGDKYLQWNEDGQLMRHTDCSGSQTAWFYDERTRLERVTDAESNSTRYSYDGNGHLTEVMFADGRTERYQPDAAGRLVKYTSPAGQITRWQRDGQGRVRRQTDATGRRTAYEYDAYGRLTTLTNENGESYRFRYDVLDRVTEQTDPGGSRRAYGYNALNAVTAVIYGGERGGEIRHGLERDAAGRLTVKITPETRTEYRYDAADRLLEIRRRQHDAAEGGEPEVIRFSYDSAGNLLSEETAQGVLQNRYDVQGNRTETQMPDGRTLRYLYYGSGHLQQINLGRDVISEFTRDHLHREVQRSQGRLDTRRMYDRTGRLTRKLTCKGMRGVVPETFIDREYAYSGQDELLKKRHSRQGVTDYFYDTTGRITACRNEAYLDSWQYDAAANLLDRRQGETAQAGAGSVVPFNRITSYRGLHYRYDEYGRVVEKRGRNGTQHYRWDAEHRLTEVAVIRGSTVRRYGYVYDAPGRRVEKHELDAEGKPYNRTTFLWDGMRLAQECRLGRSSSLYIYSDQGSHEPLARVDRAAPGEADEVLYYHTDVNGAPEEMTDGGGNIVWEAGYQVWGNLTHEKETRPVQQNLRFQGQYLDRETGLHYNLYRFYDPDIGKFISGDPISLRGGINLYAYAQNPLSWIDPLGLTGEWVNPKDINFSQRTISPHDYAEIMRNGGWDWDRSPLRVIDIDGQLVSYDNRRLDAALEAGLDKVKVIRIDPNAPHPDSSTGKTWLQKFRERFRDRRNIKAGGIVPDKGLNSRPERTSRGCK

SEQ ID NO: 62 - protein, 1412 aa, Salmonella enterica
MSGKPAARQGDMTKYGGPIVQGSAGVLIGAPTGVACSVCPGGITYGPPVNPLLGVKVLPGETDFALPGPLPFILTRAYSSYRTKTPAPSGLFGPGWKMAADMRLQICDRELILNDSGGRSIHFEPLSPGESSYSRSESFWLARCGVLMPDKSNPLHDLWQTLPEEIRLSPHIYLATNSIQGPWWVLGWPERVPGADEALPAPLPPYRVLTGLADSYGRTLTYHRAAEGVLAGSVTGVTDGAGRRFQLVLTTQAQRAEAAQAAYATAGTSGTSRSASVDFPETLPATEYGTDNGIRLSQVWLTYEPDAEGDQEPVMLSRYEYTPGGELAAVYDRGGVEVRRFLYDADHPGRMTGHCYAGRPQMRYRYNRDGRVEEQLNPEGLSYRYTYEKSRVTITDSLGRREVLHTEGEGGLKRVVMKASADGSVTRSEYDPAGRLKAQTDAAGRRTEYSLHMASGMVTAVTGPDGRTVRYGYNSQRQLTSTTYPDGLRSTREYDDKGRLTAETTRTGETTRYSYDNPQSELPSGIQDATGSSKSVTWSRYGQMVVFTDCSGYETRYEYDRFGQMTAIHREEGQSVYRAYNSRGRLVSQKDNQGRETRYDYNDAGDVTTVTGPDGSRTETQYDGWGKALSTTQDGLTRRMEYDAAGRVTQLTNENGSHSAFTWDTLDRLTQQTGFDGRVQRYGYDVTGQLVRSEDEDLVTHWHYDASDRLTHRTINGEEAERWQYDEYGWLTELSHLSEGQRVAVHYGYDDKGRLIRERQTVNDPETGTLLWEHETLQGYSEQGLANRFKLDGLPPVEWLTYGSGYLAGMKLGDTPLVEYTRDRLHREVLRRFGAGAAPEPGAYELTTTYTPGGQLQQQHLTQPQLNREYGYDEGGRLVRISGPQQTREYRYSDSGRLTGVHTSAANLDITLPYATDPAGNRLPDPEFYPDSASTVWADNRITEDMQYLYRYDKYGRLTEKTDRIPEGVVIRMNDERTHRYEYDNQHRLVHYVRTQHGETQAEGRYLYDPLGRRVGKRVWKRELVHWSDTRMELSRRPYVTWYGWEGDRLTTIQTGQSRIQTVYAPGSFTPLVRIETDAAEQAKAQHRSLAEKLSQEGSEDGQAVQLPAALTAMLDRLEGELRRNTVSEESRQWLAGCGLTPEQMAGQLEPEYTPQRKIHLYHCDQRGLPLALIAPDNTVAWRGEYDEWGNLSGEENPAHLEQLIRLPGQQYDEESGLYYNRHRYYNPGQGRYITQDPIGLKGGWNLYQYPLNPVTEIDPLGLKIVISGDPTDYNTAVAYLKQDPGMAKIISDLEKSSTTYTVYYYDGDGSFFDSSDNSIIWNPHMAVNCITKGGLLSPALALGHELAHANKTKFDKFLRSILPDALFGDYGNYEEWRVITGAERDAAITLDEPIRYDHFGRAVKVPSPRPR

SEQ ID NO: 63 - protein, 3423 aa, Sorangium cellulosum
MTSGWMRRVWPRCAGCVLLLMVMSAPLGAWAQASTLRRIGDPFRARLTGARGGAEPAAALAGDAAVLASAAEPAGGPDGLAVVPMVALPADVRAAGAGPGADPWVLFDGRGDTGLRSETGEKVRIRVSFPQPTSLEALSLYGRSEGALTVSAEDGAGFQAVSGLVDVPLHDTGERWTRLPMAITAQHVVIEWLPSGERGPQEILFWTAGAPTRGLSEVELADRVLAGRLAGAYQFAATSERATVTRTGGEQSLSLHVDTDPRALARAFLVYQLEGRGHWSSVSRQINGTAPRGGSPAAAPATGGLQVEEIAPAWLRRGDNVVRFRPSAEQEHGFTVSALRVVGIPHAGVIEARSAAEARARPAGGERAPRTDALSLDFGAAVAPYALLFQLTSAGAGELRIAPSEGAEGLRFDLKDLPPGWHRFDLPESATWPGAASVQITPAKGSRAEVSDVAVVASPVPSRARRIALSTPLHGECAEGRAHVRGFLDLAGEDASRARLFAGPEPVALGDDGSFELTLPEPEGASHRTWTARLEARLEDGTRLDRELELGPCAAGAAPSGLVVDHGAPYGAVVSPDKGAVLSFAGATLDIPPDALEETTRITIRPLMPVQVQPMGRAMRNVTPEGRAFRFGPHGLKFRKPVKLTLPVDAAAIPSGARAREIFGFYFDETVQRWTKLGRVDEGGARELTSLTDHFTDFVNAAISMPDQPGAQSFDPNAMKGIQLASPSAGVSFIEPPEANGQGTAQLSFPIEVPPGRRGIAPDLAVTYESELGNGWLGVGWDLRVSAIEIDTRFGVPRYTGDELYTLDGQMLRAIPDQPGRYERRVEGAFDRIERLGADHGSFHWVVTDKDGTRYTYGESADARLTDRSGEAGIFRWNLERVEDTFGNRMRISYFKDAPEGEDWVQLYPQRIDYTEHTSGLPGAHYHVVFTVDDGAQRRDVVSSARAGFEVRTTRRLTRVDVTMGQAPGAEEIIRSYHFAYDTPDPRHHHKSLLKSIAVHGNGGEEMLYEHGFEYFGLEQEDGELQVFSAPTEWGRPAEGRDGLGATSSVEGGLSAFVGVGPTVCDPHAGVGVSVSFGADDEDVAFTDINGDGLPDFVGSNGVWLNSLPDRSSGNAFSPESAGSTHQITVGLQGAMHLFQELGGLGVNRAWSTATAQSLLLDINGDGFPELLDGSGAALNPNNARLGPGARGAGFTIDEDFSDGEQVEALRNAFYRTSALVKWVPPIDGIVIIDGGVSLAGDGAGDGVTASITKTTPAPLPNDKFHREHQLLWQRDIGPSDAACVPEGDGGCGSGVRVRVRPTDALYFRVDPRDDIEGDVTRWNPRIRYTELCLLDTCQRMVPREMMRPDALGRPLYTYTFADDFSVLDRSVPGWAAGADGQVTVQASFVRTDALDAFDVRLVRRDVDSGQSVELHRTRVSGAQLGTEIAWPVAVLQGDLLFLYAELGENVVDPSRVQYQGFARYTEVCGHDADPGSCRAVGECAPRSGAPSGKRVCGLEASPGDGGPISVPEESIVAPVQLSDSTIGGTALPLSQLEQVDARMVGGFRGFSYGEWTTEYPFDENQLNKRPAENRPPYFTRVEPHWEGYHASWSPGDAGFPLVGSVSGPVFRGSGADMYIRAGELKPSRVGGVRPEDVANVPGLRKSHNGSGSAELALIGSFQVTTGTTESKLELVDVNGDGRPDAVTQGGVRIQTCGSGGRCDGQQPGQYGALTLEGPGDIRVIETMSARFGFGFGSAASAIAEKIEASAETKEVLSVLPSLGKSWGTSQTTRDLLDVNGDGLPDKVRSAGGVLHVQLNLGYRFGDERPWASLDPSGDPFEPLPEVDGDPLTALSRVWSPEKLSSVRVQDNTTNSLQVGYAGIGGGIAHTVSRTLVDFVDLNGDRLPDRVIKQPGQGYYRVRLNLGDRFGPEERWSAPAVSGALPWGVVLEKKFTKEINGSNDALSFSETTAFNAGYGVPIKIPTPYVCIVLEIAAQLGLSDGRSELAWEDVDGDGTADHVLKLSEGMLRERDPALRARLNLTGKTNRLSRVVRPLGGSIRLDYAREGNKVAYASSPGELSVDMPGSKWVLSRVEVDDGMGTPAYVHTFDYHQSGFYDRAEREDYGFAQVTATREDGSQIVTRYHNQDYYRRGLVAEVIEQDAEGRLFSRQEVAYRAPGAQATLTGSFFPGEEQRTMSWYEGKTTDPSAPGKQTSEERDWDDRGNLTRVIEHGEPGTLEDDVTTTIHYVTYDGPHVVRADSVEARDSAGRLLRERTAGYDEVTGALKWITSTVIGGKDPATGAPYTGDAATNPTWEFSHDAYGNLERAIEPRGFTLTYEYDDVAETYLSRVDDSFGYFSETWSDYRYGAVSAVRDVNGHEVHYDFDAFGRLRAVFGPDDPLAAAEATIAFEYALQSGESVAMPAWARTRHKDVQHPGDPIDTVTFIDGLDRVIQTKKDLEKDPGTGAAPIVGMSVSGRVVLDERGRVWQQGQPVFATGEATAFVDVALKHPTTFEYDVLSRIVERREPDDEAEGGEAVTTTSYGIDELDGVAMFVATEVDPKGKVRKAYQDVDNAIVAVEERNRVRGSEAWTTLMTRYGYSAVDELVRVTDTRGNVTTAAYDTLGRMVTLTSPDMGRTEWRYDRSGNVGARQTAKLLAEGANKLIRYEYDYNRLRRVNYPDSTDVTYVYGAPDEAGDEHGNRAGRLVEEQSEAGKRTFWYDRLGNVAKLTTEFPRLREPHRGPYQATMEYDFDGFGRLLSLKFPGSGAEVVTYGYDRGGLVRSAVGTNTQTNPQHPDEPAVTQYLQHIGYDEFEQRVRVVHGNGIATSYRYYEKSRRLQEINADHRDRYLAERGRPARAFQRMRYEYDVAGNLERVRNEVPYEQDMPGSVLVGPTTQEYGYDDLYQLLSARGTYQDRRDWQFRYRLSFAYDEIGNILTKDQASYRYVPQACPTPVPAGCDGWREDHAIRELTYRSEYQYPGPQPHAPKRIEEHLVAESMPWPREMRYDASGNQTGWTYRGSDTRTTDWNEENRVTRVTQNGQVLSRMLYDGDGERRVHLHHVSGEEETAYHDQHLTLRDGRFVTKHIYAGQTRIASKMDPDWFRDPPTLYYHPDHLGSTSFASNNEQTLTQRDEYFPSGELWIDASDSRYELRRAYVFTGKELDQATGLYYFGARYYDPRSSVWLSPDPILDEYMDGGTSGGVFNPGNLGLYSYTLNNPVNLVDPDGRQAQGGHRNFPPGSNGERSPNGWYGPEAARYNQIIQAQRIAEQQAQGKVPTSSAPAPVPPPAAQQRAPSSPPPPPAQPPRPAPPAQPAKAAAAAQPAKPAQAAPPAKPMPATAKQPESPTGSAKGGAGGERAGRNFTRAGKAAVKSANAAANAGQTTCTSCGQPTVPAQQSRTGVTPPKNETHVDHIIPKIKNGNGSPNNGQVLCRDCNLRKGPR

SEQ ID NO: 64 - protein, 3149 aa, Sorangium cellulosum
MPLSPPGGGAALSSIPFQLPSDGVGGLSLGPRVDAPPVEDVGAPFGEMVVPDEARVVAFEGAVLEIPRGAVDEPVRITIRPLDQGEVRPMGRAMVNVTPGARAYRFGPHGLRFKKPVRLTLPYDEHAIPPGMTAQHVTGFYFDEALGQWERVARDGEAAKGKLASLTDNFTDFVNATLAMPDAPGTRSFDPNSIKGLALGSPFAAVTVVAPPEASSSGAARLSHAIEVPPGRNGIEPALAIAYDSEHRNGWLGVGWDLRLSSIEIDTRFGVPAYAAGEAPRYLLDGSELVQVEGGACGDPCLFRRRVEGRFDRIVRHGTGAASYFWEVTDKDGTTAVYGRDANARLDDPEPAPGQPRNVFRWYLDEVRDTFGNQMRVRYDREIEPGPPPRIEVHPERIEYTANASRGVEAAYAVDFVSEGGRPDVMLSGRPGFLEQTEKQLSRVDVRFGDVVVRSYALHYIDGDFGKRLLQAIAFHGRGARQAGGQVTVGEELYRHTFEYFTAPRTASGEVAAFAQAAEVWGQAKARSGLSRTEDSTAGGSASVGLGIGMFSISVGGGGFFGDETVRKSVFDLNGDGMPDFLEDSGDVGLNLLRAASGNHVTAASALGLFDRDLGLTDRSGWSVYAGLNVAALSGSVGYTRSSTEDEQIVTDINGDGYPDLVSGGPLGGVYAALNDRRGRFGSKQPWGALDTSGAPSGRPDLAQAARKDLHPADPLLRWIAPFEGDIRIGGALQKQEAGGDGVRVQIVRSGEEEPLFDDVLDGDELTPCLLGAHRCGGDVLTTHVAAGDRIYFRVSAAPAIDPERRVDTAADLISWSPSITYDVSEAQLAQAGPDGAPIHRFEYSHDHRLAGRPDVPWVAPADGSVRITGDLTKWATSDELWVEIVRERGSAAAESILAPQHVGAGAGGLGLGALLPEAIPVLAGDRLRFRVKAELPDDPARIAWSPVVRYEEYTRVDRATGAPRRGQVQCSAQPNGRTGCTLHNDGPGDGPLPLALIEQRAHVSMPVARWSHATRPRPWIAPSTGTARLEGLLLVPGTYTFTQPLTLVVQGVHRLLFKQAYSAPSAAGTAFPVDIDLEVQAGEPIFVTAFAQVPPTGAALNATIDGEPVSLGVFAPEAAASAGSEDPMAGGFHGWSVGFLDGDRAFSEADIAFPTLHPERGFTLAVPLPQGSAPVWGAAASEAFVGGSSVKPSIVGKVRRGDGQLGRLRSAETWNAEISANLGPLGAGYSFGSTTSDLDLIDINGDRLPDSVTREGAVLNTGRGFGPRDSWSLPEALRRIEHRAIRLEGSASVTVDSEIQTISKTTSEGRFEGYLHTQFRVGTSYGLSATHVDLVDVNGDGLVDQVTQDPQSGVMKVAFNLGHRFSGPAPLERARFEKSDFNAGTLRETLGDILSEFTDAAGVDAVRLEDTGANSVGVGVDATVAAAGAGYTYTTARTVVDFADVNGDGLPDKVMKDPEEPWFRVQLNLGSRFAPEESWPAGAWGVSIDPPEYAFMGGGDAVSFRRSESYEGSFKVDVCYFVCVGGSVFYSEGAGSSHLAFEDIDGDGLQDHVLKRDGDATVYARVNALGKTNLLRRVSRPLGGGIELDYRREGNLVVPSEGALGEMDRAPQVDMPSSQWVLSEVTVHDGVEGAPGVYGVHAYRTSFATHADGVYDREERVELGYGLVTTTALGEDGVTAMSSEDVEHLNHDVYRRGLVARSTLRDGDGLLYTVNEVDYAPPPQGLEPGMGWFFPRETERRSAFYEGTTDDPSAPHKSTRETRVFDELGNLIALHADGEADTPDDNVHQRVEYTEPGSAYIVKPELVETTDEQGRVLRRRTATYWPGTGALRTVTNVISGGKRADGTTYANAEATWSYVFDDFGNLETSTDPNNYKLTYSYDEVTHSYRTCASDSFGYRSNSVPNLLYGTVAQETDVNGHTMVHRVDDFGRLTEVWAPSDLAEDGEDAGPVGCTPTTVYDPEALVGEGEPTIGFEYALQPDQTAALPAWAKTSHKDVEHPGDPIVTMTFADGLGRVLQTKKDHERDTGTGTEVGMTVSGAVAFDALGRVVEQGQPGFSAEPDTAFVSLALLRPTLTRYDAVSRVREVAMPDTSALDGYARTAIEHDLVALEGRLLFQEMVIDANAKMRNTYRDVGGRIAAVEEFNRIQGVETRIVTRYQHSPLGELVRVTDARNNATTATYDSVGRMVTLVSPDAGRTEWRYDLVGNLRAKQTAELAAQGQLIRYEYDFNRLRKIDYPVTQDVVYTYGEPDDAGDEQGNRAARLVEETSAAGKRSFRYDRFGNTAELTSEFPRLREPHRGPYQATMKYVFDALGRMQELHFPGSGEEIVRYGYDRGGAVVSVVGENQRVNPQHPSEPRTTEYLRHIGYDEFGQRVRVVAGNGIETKYRYDESTRRMTEVNADHQSAQMRSMGRSPRPFQRLRYRYDLVGNIRELNNEVPFDESLGGAVMVARTQQRFAYDDLNQLTEASGIYQERGNEQQRYTLGVDYDVLGNATAKRQEVAQYGRVGGNNWQMQYPIRERTYRNDYRYTGPRPHAANQVDEYVPAESQPRLRELFYDANGNHKQWKYRGNLQRTLSWDEDNRLVSVSENGQEMSRALYDGAGERRVHLHRVAGEEETAYVDQHLVVRNGVIATKHLFAGETRIASKIDADYYQRPPVLYYHPDHLGSTQYVTDQDQALSQHVEYLPSGELWADQTDSRYQNRQPYLFTGKELDLSTGLYHYGARSYEPRLGVWMSPDPILDQYMRGAPNGGVYEPIHLGLYTYTRNNPLRFVDPTGMSETCAGGGCESYAGALDSEAQSVDPAATECTSGGCMSMSPTIAQLNDISRSQVARAHAEQISRADVPIETSLVDPIDLVGAGGGIKVLWKAGSRALTKLATRQTLAKAEALAARGAGGLCFAAGTPVQTEDGLRPIEKVRPGDVVWAQDEVTGEIALRRVVRTFVTPDQPVVEVVLEDDDGQAESIRSTVEHPFWTQRGWVGARQLTSRDRVLQRSGTWSRVVTVSETGESVTVYNFEVEQFHTYFVGERGVLVHNNSDIYAAARQAIGTVSGSLFKPLQCVQCASAMANALKARGIPGQVLQIRAKAGEFIASDLVKSGTTSITRNGYHEAVRVGDIVFDNFFPGGVPYQTYVDSLHAIGGVAIKAVGF

SEQ ID NO: 65 - protein, 1492 aa, Streptomyces bingchenggensis
MADTDAVRPPQIRIPVGAKPKDLIPGNPADVDDLVLELRAYAGAFQDGKDKLRPADLEDWQGRGAGEFRKAVDRLPKELTSGHDQFTHAASALASYATKLRSVQKRCEPIIEDADAARAASKAHHKKVNAYDDAVTRGDEQLPEKPSETDPGISAMEDCIGRLDKLVAELQLVVDASKKKIDKATEKAPNKPSNWQKFGEGVKDGLWKAHYGILGLAELPASLLKGDLGGFSMQLAGMVDGAAYAAQHPKEFAKAALNWEMWSKDPLRAAGEITPELLLAVATGGSSVLRKKLDTGAGAAERLAARKKALGRDGEAHDRANRKGTHDQCGAEKKQCGDPVDVVTGEMVMPATDVSLPGALPLVLERTFVSGHTCGGWFGRTWSATLDQRLELDADGIVFVAAEGMVLRYGVPHPEQDIYPVRGPRWPLRWDGTAGGTMRIEIPEQARTLHFTPLAADGNELPLQRIEDRNGRSITFTYDADGTPREAVHSGGYHIAIDTDPELLRITALRLLGVGDAEAGTTLVSFGYNGAGDLTEVFNSADEPMRFTYDDQHRITAWTDRNGTSFGYVYDHRGRVLRTIGSDNMMTGRFHYDEAARTTVYTDSLGNRSTYVYNEAGKVVTETDPLGNTTRTQWDPQTNRLPLSVTDPLGHTTRYTYDDAHNLIRVERPDGTAATATYNEHGQPLEIHEPDDATWLHTYDTRGNRTRTTDPTGAATHYTYDDSGNLTSVTDPLGHTTNVVCNKAGLPVEVTDPLGNTTTIRRGTHGRITRVTDPLGHVTRQGWTIEGKPSWRARPDGTRETWTWDAEGNLVEHTDPAGNTTRHTHTHFDLPATRTDPDGATYAFTYDTELRLTAVTNPQGRTWTYAYNGAGHLASETDFNGRTLTYEHDAAGRLISRENGAGETLAYTRDTLGRTITSRTADGTETTFAYDAAGRLTQAANPDTELRRTYDARGGVLTETVNDKTTTYTYDQAGNRTARTTPTGLRSEWAYDATGRVTSLTTADNSLRFAYDAAGRETSRTLGDDVSLTQAWDALDRLTTQTLTRGNTSTLLQHREYAYRQDDHLTEIRELTSGTRRFDLDQVGRVRAVHAHGWTETYAYDSAGNLPHATAPGHEASGDREFTGTIIHRAGRTTYEHDAQGRLTRRTRKLLNGQTRTWTYTWNAEDRLTKATTPDGEHWHYTYDPLGRRTTKQRLAQDGTAADQIHFAWDGTRLAEQTTMDGAVTTWDYSPGTHRPISQTEHHSSREVVEKTPSILHLTDTTPQSEYDTRFHAIITDLVGTPTELVTADGTLAWQHRTTLWGTLLPTPPGTADCPLRFPGQYADPETGLHYNYFRHYDPENARYTSPDPLGLSPGPNHYDYVSNPNVWIDPFGLAPEGCTSADPHALKPTHEISGNSSTKRVKKMMDDMRNGTFDWEQSPISVVKDDDGTMYVVDGHHRLAAARRINLDEVAIRDVTQQLKDGELPGYKDIDDVTSSASEYRGNRLNQYKLR

SEQ ID NO: 66 - protein, 2265 aa, Streptomyces clavuligerus
MPGVPSAEKPVAGSFGTASVPRASWRGPQGPQQQPRASWPAPGRTTVAVSDPGVPGAARSATARSGPIRITPAALDPAQKQRSTRTAGQAAPRTVETRILDRKQTERAGVKGVLFTVAPGPGTTAARTAPVGVTLDYADFAGAFGGSYASRLRLVQLPACALTTPAKDACRTETPLAGKNDTVRQTLTAKSVGMRLGAATVLAAVAAPEGDKGTYKATSLASSASWSTNLNTGDFTWSYGMPVPGVPGELAPKVGLHYSSGSIDGRTGNSNNQASWVGDGFELSPGSIERRYKPCSEDGAENADGSKPGDLCWAYDNAFLSFNGKGGELVPVDLKAGTFKIKNDDGTKVQRLYDTNRANGDKDGEYWLLTTPDGTEYHFGYNRLPGWTTGKDTTNSTWTVPVFGNDTGEMCKGTDFASSWCQQGWRWNLDYVRDPHGNVITYHYGKEENSYGRNLKEADDTPYTRGGYLKRIDYGLKSDRVYTDKPLAQVVFDSDERCLPETGVTCLPDTIKDKSFYWYDTPWDLNCAAGTTCDKGRLSPSFWTRKRLTQVTTQTLNAGGTYDKHDSWKLGHRWGKPDVDYQLILTDIQRTGHTATPAVTLPRTTLAYTQLENRLDKTGDGYAPFVKERLSTVDDETGGKVSANYSAAACDWNALPTPQSNTTRCFPQYLGGDNVAAAELHWFNKYVVTSATTTDRSGGAPDAVTRYQYLGDAAWAFDKGDGLSKEKERTWSQWRGYGHVRVQTGGQGGTAAMKSQRDTHYLRGMDGDRAGVKEEDGKKTVTVQLGEGEGTPITDHESLSGFSYKTVTFDKPGGKILAKTVSRPWHHETGKKDRTWGTVTANLTGNAQVKGWESIDDGAGAKWRTYTTDNTYDTVAGRLVKVDDFGDDTTAEDDQCVRTTYPAGTPAILSLPSRVETVAKACAASTDRTKDVITDVRTAYDGKAYDAAPVKGDVTATAVLKKRDAAQAVYLETGSTYDGYGRVLTSTDLTADVTVPTGKAPTRTARTDGRTSTTVYTPATGLPTQVKTTTPPADTKVPGSAQTSTQDFGARGLPVRSTDTNGNVTEQHYDALGRNSKVWLADRRTTDLPSHEFAYHIQDGKPSVVISKTIDNNQGQISSRVLYDGFLRERQSQSPGPDGGTILTDVFYDERGNAVKSFAPYYTTQKAKLELFTPDEALSVETQTHTTYDGLGRQTQVRQIAGNGDGGAVLSTSTTTYGGDRTTVVPPDGGTTITNILDGRGRIAEVRQHHERSADSAYDSTRYKYTPSGQLATLTSPSGAVWRYVHDQLGRTIESSDPDKGIVKSSYDDRGQLLSTTDARQQSLHHIYDNLGRKTEVREGSATGKARAKWVYDTVAQAKGQLAESIRYHKDQAYSSKVIAYDRLYRPVRSAVVIPEAEGVLKGTYQNATAFKPSGLPASISYSAAGALPGGAVVTTYDDILRPVGVTGDGMSASVIHSLTGKPLQYTMNRSGGKKVQVTNTFEWGTQRLATSRVDREEQNGVDRHVTYRYDDAGNVRSMADVSRTGTDNQCFAYDHLTRLTEAWTQSATTCAAAPASDKIGGPAPYWHSYRYNKASNRTTETLHDTTGQPAKDITRSYTYPEAGQPRPHSVLSVTSSGPAPTTLNYGYDDVGNTQTRPGQKLEWDVEGRLTKVTEGTKTTEYVYDADGNRLIGRTPTETTLYLGHTEITLPKGATAAKATRYVPIGGGHTAVQDNDRSHTFTIADHHGTGQLAVKAADLSVSQRRSLPFGGPRGDAPASWPGSKGFVGGTDDTKSTGLTHLGAREYDPSIGRFISADPLLQTSIPHTLNGYSYAAQNPMTSSDPSGMGVPECHSGALSKCQNGAPTKESKYHPEREPKTCTSNCYSGPEAGSGGGGGGHRAAASMGGGGGGGGGGGWSISSAAKSVWNKGAALVEQAVEIPGEATYGLVSSAAYTSELFGWTFDGDCWNGGAGAAGCDYGTQWDNWIGEQGVDTSSVTYQIAGLVGSLVSRRPTGAKPGPKRNPDCKGSSFVAGTEVLMADGTAKNIEDVQVGDMVMALDPETGEWAARQVTHLIRSQGDKQLAELSIATDDGIEPLTATDNHPFWSPSERRWIDAADLTAGMTLLTDSGTTVLVTANRARTERIRVYNLTVDGLHTYYVLAGGTPVLVHNCGGAVQSHPSRCNCANGDVPKVRNGKLAGSVHPNTGVPFDAQGFPDFSAWRHPQVPDVRIQLTGSRSRDFRLANQAAGLPSTPTGYTWHHHQDRGLMQLIDRQVHADTGHTGGF

SEQ ID NO: 67 - protein, 2304 aa, Streptomyces griseoflavus
MPTVALALLAPVGQLPAAMADEQGLGRPDVPKPRVSKVEEVKGLGAKKARQKVSEGKKAGELRARKAKKEQTAAWPKPDTATTTLSANKAAKVDLAGTPVAAQPVKSRSMPAAAGSVDFTVLDQNAARKTGITGVLFTASADTAGTAEVSVDYSVFASVIGGGWSERLRLVQLPACALTTPSKTACRKQTQLSSANDFAQQTVSAQVPLAETTSGASTQLSSANGLNNFTVFAVTAAAAGAGQTPKGTGDYSATGLAPSSSWEAGGSSGSFTWNYGLTLPPAAAGPTPSLGLSYDSGSIDGRTASTNNQGTQVGEGFAFTESYIERTYGSCDDDGHDKVFDRCWKYDNARLVLNGSSSRIIKDNTTGAYRLENDDASTVKRSTGADNGDDNGEYWTVITGDGTKYVFGLNKLEGAADQRTNSTWTAPVFGDDSGEPGYDKGSTFADRSLTQAWRWNLDYVEDIHGNASTYWYTKESNHYPKNKAATANASYIRGGYLSEIKYGLRKSELFTDDADAKVTFSYAERCTVTDCAELTEDTAKHWPDVPFDSICTSGDADCNAAGPTFFTRKRLTGIHTFSWNATTSKHDPVDSWALTQEYQDAGDIGDTTDHVLVLTSIKRTGKAGTAIDVNPVVFTYQLRPNRVDGTDDILPLKRHRIETITSETGAITTVTLSAPECKRSEALEAAQDSNTRSCYPQFWNINGATEASVDWFHKYRVLAVGVADPAGQNQTVENAYDYSGAAWHYADDPFTPKDERTWSEWRGYRDVTVYAGALGTTRSKTVSRYLQGMHGDKKKDGTTRTVSVEPLMDTDVDFAALTDSDQYSGQMLQKVAYNGSQPISTSYSNYTSKNTATQTVPDAATHIARWTRPNTSYASTYLTASKSWRTHVVTNRYDDLGMVREVDDYGQKGLGGDETCTRTWYARNPDAGINSQVSRTRTVGKECSTADTALDLPVDDKRRGDVLADTAVGYDGASTWSESMKPTKGLVTWTGRAKGYASGSPSWQTITSSSTTDFDTLGRLTKVTDADGQPTTTAYTPATAGPLTKTITTNPLGHRNTSFLDPRRGQALRTYDANLKKTELAYDALGRPTSVWLPNRSSASQSPSSKFAYHMDNKNQSWVSSSTLKKDGETYTTSYAIFDSLLRPLQTQSETPQGGRLLTDTRYDTRGLPYESHADIFDTTSTPNGTYTRAEYGEAPKQTGTVFDGAGRATKTTLHVMGVEKWSTTTSYTGDSTATTALDGGTATRTITDIRGRTLETREYAGGAPADPQYGDSPGTSYASTKFHYTRDGLQTQITGPDDAKWSNTYDLFGRQITAVDPDQGKSTTEYDALDRAIKSTDSRGKSILTAYDVLGRSTGTWAGSKSDANQLTATSYDDLLDGLPDSSTRYVGGKSGQAYTDTITEYDTLSRPAVSKLELPSSDPFVKAGAPATLEFETAYNLDGTLKHTKEPALGGLPSEIVEYDYNKLGQVTSVGGSTGYLLNTEYSPIGQPTQLTLGTANTDDHKKSYLNNRYEQGTDRLIRSFVTDDTHGYQLQDLNYTYDQTGNVTSIADPTTLGGTSSAETQCFAYDGHRRLTEAWTPSSQKCSDARTTSNLSGPAPYWTSYTYNKAGQRTTETTHKTAGDTTTTYCYTKTDQPHFLTGTTTKSDCTSPEKTYTPDTTGNTTKRPGATAIQDLTWSEEGKLAKLTENGKATDYLYDASGELLIRSTAGGEKVLYAGATELHLRADGTTWAQRYYTAGGQTIATRSNEGLSNKLTYLAGDHHGTMSLAINADATQTYSKRYTSPFGAERGKPTGTPWPDDKGFLGKTNDETTGLTHIGAREYDPAIGQFISVDPLLSLDQTQSLNGYSYANQHPATASDPTGLKEGCGATYAVSSCGNIPGKSGVNNAVSGGNPGSPGNSGSKKPYGGAIGGYHDVGYGPSQVRHSSPWTPPPPAYFEVIAAPGPEPDQFEKAFSTALANLQSDRMYNYLPIHELMALAGASVCEEYIECSQELHHYFVWTLRYSPEYIESMGPMVGSIGGTPYSLRGKGNPPASGPWKETCNRCFLAGTDVLMADGSTKDIEDVKLGDEVLAANPETGELGPREVTRLIRTEDDKHFNTLSIATDDGIEELTATHEHPFWSPSEQSWIAAGDLTSGMTLLTDDDRTVIVTANKPFTQHARTYNLTVDDLHTYYVLAGKTPVLVHNAGECPVTGLPHGALGESATLQRLQNEGYANITREVRFRNSQGDVFRADFVAQNRSGNWVAVEVKTGRGASLTGNQALGYAELGHGGAVLNTRRVPGLKKGSTVTMKVEVDLWRCPDC

SEQ ID NO: 68 - protein, 1726 aa, Streptomyces violaceusniger
MAFWMAAASVWAVLQLLLLSWPVRTVRWPTVLLAFGVGAYGCGVLSMALELVVARQLATAREKSLSGVMDVVSWTTAPVVEELIKIAPLLVAGWALRRRMQWGLADFVVLGGAAGAGFGLLEKLLMYAESAGKAVPTDEGGWQIAGGLFDPPYVPGLGQILGSWFPSSTGTVDVGGPTLPYEVHIFASALGGLAVGLLWCGARVLTRVAALVPLAGAVAIHWVTNYAAAFPSDHTAMEWRERLAGEWGLWIILGCLAVAWIWDVRRSRLGRRHQPDVVLAAERQGRTAPEALFGYALLRLPATWIIALGYARQRRALLYATAHPRTRAEKLEPLRESVVQQTHRMDATHRQEAWRGVTFRQLWRRAREQRPRWPRHEKVLLVLSLLLAVPSLLYLAVGSFPSTKDLQEYFTGGTGLRILVGVGLAGLVLTLWRLISAVRGYRTAGASPLGEALALVQFRIAVCAGSLVVGVLLLSRWSAIADGEAPLAGYDILGTDRFLLEKLLEIGLPLLLTLAMFAMPYALPLELAMGGGLAETLLMGLAPRALAPIASRVGARLAAREATQWARGALRSRGRGVFSRTWDRVRHGRTDPVDVATGRMFLPQTDVELPGVLPLVFSRRVDSGYRAGRWFGPTWASTADQRLEFDEQGVVFFTEDGLLLAYPHPEPGGTAVLPAEGPRWPLARTADGGTYTVTDPDAGLVRTFAPYRDEALALLREITDRNGNRITFAYDASGTPLEILHSGGYRLRLTSENERITGLYVGDVRVMGYGYTDGHLTEVTGSSGLPLRFVYDRAGRVTSWIDTNNRWYSYAYDEQDRVVAEGGEGGHYTLRIGYDGVDPDFPGLKVTTLTSPDGAVTRYLIDEAHQVVGEIDAGGAVSRMVYDQAGRTVAETDPLGRTTGFRYDEHGHLTAVIRPDGSEISAVPDAQGNPVQITDPGGAVWRQTFDTAGNRTTLTDPLAATTRYLYDARGGLLAVTDPLGATTRVRCDEAGLPAEITDPLGATSFYQRDAFGRVVAETDPLGAVTRYDWSPEGKLLRRTGPDGSAESWTYDGEGNRTTHTDPVGGTTVYEYTHFDLLAARTGPDGVRYEFEHDAALRLTRVTNPQGLRWSYEYDLAGRLVTETDFDDRNVRYAYDAAGQLTARTDPLGRIITYEYDIVGRLIRKASDDRTTTFTYDPAGLLTSAADPDAEVVYQRDRLGQVTSEMVNGRVLTHTYDPLGRHTRRTTPTGAITTYAYDAAGNRTTLTAGNHILASAHDAAGRETTRHIGDALTLTNAWDPLGRLTTQSLTGASSNVHHRTYDYRADDHLIAVDDNLSGRRTFELDVVGRVTAVHAPGWTETYAYDEAGNQTHAAWPSTQPAQEATGPRTYTGTRITGAGSVRYEHDEAGRLTLRQKTRLSRKPDTWRYTWDAEDRLVSVTTPDGTVWRYLYDPFGRRTAKQRLAADGESVLEQTDFTWDGPTLIEQTTTTPGLPHPVTLTWDHEGLHPIAQTERVTEATTQREIDARFFAIVTDLVGTPTELVDDSGTIAWRTRSTLWGTTTWASDSTAYTPLRFPGQYFDPETGLHYNFHRYYDPDSARYLSPDPLGLSPAPNPATYSHNPNTWFDPLGLSPCPGGNHNWAGNPAEHARLKRFYEQAQKYGKAGYRELESGRFRFYGKITPATKEGEIMGRRLVREWDPATDSTRIWHESLDHSGRVRITRPDVKFTGGKKVHYLFDGTGNLTGTF

SEQ ID NO: 69 - protein, 3395 aa, Verrucomicrobium spinosum
MMTKSTPRVFLCLATAVMAVSSWLTPASAQAPSGPQPRTGRFSYGAGDDPTYQAFVIPLDFQKGVQLSPTGIAPWASGLDYGAYPWFFKIAGQSSFLIQNNSGTVTYPLEVQNPIAGFGSESGGTPLYIGQSSRFALHTGGQSAATDVPDEMSIRVYRRSDFAQQGNVVPVQVQALDIPHWKGASATNSAAEWKQFGDNGFQKTFVTTVGGVQVLETTVQLALEAGPDGMFGAGYSAPFIITHRALPGAEEYYFSVAAVGNTMVGSNAHWLAVSDPAQPGTSGTFVVGYALNFESAPPWGTTLVKTPHFQGEPAPPTYHGKTAEEIQALTPRFEHQFAAPAGSTYTQLSQAPELQGHTILDRFVTEMGNNPMALVNYVHNEIGLTDALGYNENGDIDEAAVNAGGINRSALATFQEGQGSPDEQCALLVYLLRKAGVHASYVRSSPNAVKMLDQRLSNLLRMRLKGMQTPDGTQPVPQLIGVNYPWVAAYVNVDGVNKWVHLFPWLKDTEVVEGLAVEGYLPSGTKSIREWVRKYLKAGAGDALWTLDAEDRTPGNIFLKDLDKSLQQNWPGLAKDSLGVRFRNRKFNRVQWKEFPQPTQFNTTTGTYTQSDRVSADGSRFDTVDIEIASVQFPTNKAVINGVRIMDMHNRRAVVSIAPRAEAGHYDMTFTMQPFDLENPDSGTGNYTYGADAHLRKKQVTTQHVSTVDDQFSFKVTYHRQRNYGGPVGVADQNLLGGWSHFAGITNLDFGPNQAAQAGSATTSYFNLGDLNAFCLNTGRVTDRMLKVHLEPFWKHEQERAANSSINPDYDLIQGTMAYLMGMSYYQRVSRSFETLKDTFKVHAVSMRAHGFAQLGAELNGTRDPIMVTVPNQAAKRPNLVYPVVDMNFSRTAWAGYGDLRPDAGGQGMITGADFMTNLFIAEISALEHHTIKEYIKVEDSDAVSTVDLIHRVQQDGNANTNVVELTADNYVTEKTKTYSFESQTKTLQNWAPSLWTSVEAAFSGWDKNLARVFITPGPVAGAAGQWKGMGALIIGKSQAGALIGRINGGASNWLFGGSNTYSSSSLSFGSSTISISSSGTLSFSPQPAYTPSYGFLSDSWSMSSTSSVASLLGSAGGFLSSSSSWYYDVYSTPSGSLGSQFLSNVSTGMLLGNTSSTLTFGDYYGSSGYGGFVGDPVNSITGELYADELDLTLPGPIPLQIRRNYSSQSRAYGHFGYGWKMSYFPYMVPVDGTDKLQVAELDGSVIVYARNTANLAQEEWTVRAQDNPHLTNGDGLELGSVRNLFRNRILRTSPGGVVTYTLYGADGSTRVYEKRSYPVFGASPAISRERPYLKRWTDSAGNYLDFKFFGDGVSGDPWYVATSNSSYGELARVQASNGNYYGFKYDVYGHIVEIYTGDGRRISYRYDGSGDLVEVTLPDNSWVRYDYLHEQGKVGSTSNTAWSSTHLIKKEIRPGGRTVESDYQLYVQGDLDLEGNVIGAGSDKIGKTSHLRRVVQQRATVGKHSGGNNEALPAAESYEPVRNATYSYFNSEDANGMTTGRTEILDAYNRKTIYYYTNNRLTKVFDPVSTVTNAATGAGTNPKMEQEWYTALDVTNGVPGAFAGGLKSLQHRGGVRTEFSYNSGGDATEIRVKGDLDGDGVFTDVAVTTATYNSLHLPELITHPHPTTGLATGRRTRYYYQDAARPYAVTRVENQDASGTVLNASTTSYQDAFSNPSNQAQVPFCKGMVSTTKMAEGTAEEAVTVYQQDARGFITRRTGYSGQVDQTNYPDVVIEYSHNLRGELVEERVMEGVVARKVNRYAYDDMGRRLWIENLNESGTQLGWNYTYYNLTGEVEWTDGSRTNPEDYTYTRYDGAGRKVEHVAWRSRAKADGTGVEAVPGVEQYATTKYFYNLFGDLIKIMDPRGHTGKAGYDGIGRKTLTEAYQGDWQNGGTLLARETTAYDDALLKVTQTDSRGGVTQKFFTSDAKPRRQINPDGTVLEWRYYLDGRIKREPVSEHQYHEYAYNDTTRTTTKTLKNASGQTQGSEVTTADRRGNVVSSTNFVGHVTTSTFDNLDRAMTTVLPASGATSAAQSTTVSYDAAGLKNKAVSSLGESTETVCDALGRKVSVTVRNAANAIITQSASTYSLDSHQVTATTGSGGEQLTQSTWTDTAGRTVLVKHADGTYARTEYDAAGNAAAVTDESGQTTKTSYDGMNRVALTLLPDGAATQYIYTNLGGGGQKVERLMPQGLKEVATLDAAGRPTESYLEGSGGVQSRRYHTYQFYTAGKEKGMLQLFTDPRGLVHTSTYDDWQRILATTVGTVGSPAYVKREMLAYDVRGQVTHVKETTAAGVTEILRAYDGQGHLEYEKTKLDGVVISHLANTYDGSGRRNGLARGGDVSPLGSGAGGSWGFGYRADGLLAQVSLGGGTFNYTYGDSGLLKTRSNPFRTYTVPGSGGRDNRGRVLAAQTRLTGRSVDVVAEAISWTSDSRQASYAATRLTANDGTGTATWQDARNYQYSAQRRQLISESWVPGDGQSARTQLHEHDYGQPGGLGIYTGRETPAPSGSTGSQLFLVNDAAMEGGAGINALGRVTREVSGFETLGLTAQGTAKGAKNVELVVNTKSELSEVQHPAATRFTSGAWSRQLWMPAGGYNLLAKGNHPSGQFSAQANATFNLGVRHFGVENLFDDDGNVTHRHIAGGFAQNGRSQSLTWDGFGRLVKVVQEEYGGFGYEWTAVYDGFGRRLQTKYVPKRGNLYQTAEQVIERSWYDPLVEFLEVGIEITRGSGGAAVTERWWKVHGPDLSGGYGGLVGMGGLEALVNEANAQAVGTVDDAYGHIVGFARATTLSAAAGGTLAFEWNDARFGGYGPLSGSWSPSLPDGLSVWRAFGWRGKRQDVTGFYHMGARYYEPASGRFLSTDPMGHEASMSLYDYAGGDPINFVDPEGRSAINIWSSPVLGTSYGIYSESWNSGSSSFGSGQSAVPPAVQPKTGFLSGLWGGTKDLAVGFWEGAENIGHTLGYAAVNIFDNDLAEELYGTGYHRMAGFTSEVGYQLTSIYDNDLANDIYGSTRNGFADTIANYGLDLYEGNRNVGSDLQFILKEASGGQDASWDYRAGYVIPAIVSAIVERKMSTGGGLPGYCFAPGTPVLMGDGSTRPVETIREGDWIMADDPEDERAAAPQRVLALHKNWSDHLYEVRVDNDRDGLPDGALKATGGHPFWTKNRGWIKVCNLQPNDILADASGGDSRVLDTKVEERISATYNLSVANIHTFFVMAGKVPVLVHNTNPGPRTYIIYQAPIQGTNQIYTGRASMPGLVSGTDVLDYRFAGGHHRGIDFSSATVVSHVQSLQGTGSVEYQAIRGAEQIWYDRAVLNEHAARQIAPISASNVMRDDYLRAAQTLNQSGSLDLPCPRR

SEQ ID NO: 70 - protein, 2732 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELRNRDTRHSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 71 - DNA, 3495 bp, Yersinia entomophaga
atggataaatataataattattctaatgtaataaaaaacaaatcgagtatttctcctttgctcgctgctgcagcaaaaattgaaccagaaataacagtactatcaagtgcatctaaaagtaaccgttctcaatatagccagtctttggcagacactttattagggttaggttatcgctctatttttgatattgctaaggtttccagacagcgctttattaaacggcatgatgagtctttattgggaaatggggccgttatttttgataaggccgttagcatggctaatcaggtcttacaaaaatatcgcaagaatcggcttgaaaagagtaatagcccattagtgccgcaaacgtcttcatcgactgatgcatctagcgaatcgcagacgaacaagctacctgaatacaatcaactattccctgaaccttgggataacttctgtcgcccgggcgctattgaagcattggatagcccagcaagttatttattggatctgtataagtttattcaaagcgtagagttggatggttcaaatcaggcaagaaagttagaaacgcgtcgtgccgatattcctaagttatctttggacaatgatgcactgtataaagaagttactgcgttatcaattgtcaatgatgtactgtcaggcagcgccagggaatatattgaccagtcaggtcaggcagataaagcggttaatcaaatcctaggggatacgcattttccctttacactaccttatagcttgcccacccaacagataaataaaggactcggcgctagtaatattgaactaggaacggtaattcaacgtgttgaccctcagttctcctggaatacgactcaagaaaaatataatcaggttttattggcatatacccaattaagcagtgaacaaattgctttgctgagtttgcctgatgtgtttacccaaaattttttaacccagactgaactctccgccggctatttaagcgccagtaccacggaaatcttggcggaaaaagatctttctcgccacggctatattgtaaaagctgcggacaatataaaggggcctactcagttagttgagcatagtgacgcctcttatgacgtaattgagttgacatgtaccaatcaggctaaagaaactattaccgttaaattacgcggtgagaatattattacttatcagcgtaccaaagcgcgtatggtgccttttgataattcttccccttttagtcgacaattgaaactgacttttgttgctgaagataatccttccctaggcaacctagacaaaggcccatatttcgccaatatggatatttatgccgccgaatgggtgagggaaaatgtcagtagcgaaacaatggtaagccgacctttcctaaccatgacttaccgtatcgctattgctaaagcaggggcttcgttggaggaattgcagcctgaagctgacgcgttcttcatcaataattttggcttgagcgcagaagacagcagccagttagtcaaactcgttgcttttggcgatcaaaccggttccaaagctgaagagattgaaagtttattgagctgtggagaaaacttacctattgtttcacctaatgtcatctttgctaatcctatttttggcagttatttcaacgatgagcctttcccggctccttaccacttcggtggcgtttatattaatgcccatcaacgaaatgcaatgacgattataagggcggagggcggaagagaaattcagtcactctctaacttccgactggagcggttaaatcgtttcattcgcttacagcgctggctggatttgccctcccatcaacttgacctgctattaacatcggtaatgcaggcagatgctgataattcgcaacaggaaattactgagcctgtgctaaagtctctcggtttattcaggcacttaaatttacagtataaaatcacgccggaaatattttcgtcttggttatatcaattaacgccttttgccgttagcggtgaaatcgcattctttgatcgcatatttaatcgtgaacagctatttgatcaaccctttattttagatggtggtagctttacctatctggatgctaaaggctcagatgctaaatcggtgaaacaattatgtgctggtttgaatatatctgcggtcactttccagtttattgctccgttggtacaaagtgcattagggttggaagctgggacgttggttcgcagttttgaggttgtgtctagcctttatcgcctggtcagtattccgcagacattcggtttatcgacggaagacggattaattttaatgaatatcctgaccgatgagatgggatatctggcgaaacaacctgcctttgacgataaacaaacgcaggataaagacttccttagtatcattttgaaaatggaagccttaagtgcttggctaacaaagaacaacttaacgccggccagcctggcattacttttaggtgttacccgattagcggtggtgccgaccaataatatggtgacgttctttaaaggtattgcgaacggtttatcagagaatgtgtgcctgacaacggatgatttccagcgccaagagttagaaggagctgattggtggacacttctatcaacgaatcaagtcattgatgatatgggactcgtgcttgatattcatccagtctggggtaagtcggatgaagaaatgctcatggaaaaaatacaaagtattggtgtaagcaacgacaacaatacgctgagtattatcgtgcaaattttgattcaagccaaaaacgctcaagagaatctgttatcgcaaaccatttctgctgagtatggagtagagcgcagtgtggtgccgcttcaattacgttggttaggtagtaatgtttatagcgttttgaatcaggtattaaataatacgcctactgatatatctagtatagttccgaagttgagtgaattgacttatagcttattaatttatactcagttgataaattcgttaaaactcaataaagaatttatattcctgcgtctgacgcaaccaaactggcttggtttaacacagcccaaattatcaactcaattatccctacctgaaatatatctcattacctgttatcaggactgggtggttaatgcaaataaaaatgaagacagcattcatgaataccttgaatttgcaaatattaagaaaactgaagctgaaaaaactctcgttgataatagtgaaaaatgtgcagaactgttggcggaaatattagcctgggatgccggtgaaatattaaaagcggcctctctacttggattaaatccacctcaggcgacgaatgttttcgaaatcgattggattagacgactacagacattatccgagaaaacgatgatttcaaccgagtatttatggcaaatgggcgatttaacggagaattctgagttttctctgaaggaaggcgttggtgaagcagttatggccgcgttaaaggcacaaggagatagcgataatgtctaa

SEQ ID NO: 72 - DNA, 4095 bp, Yersinia entomophaga
atgtctaattctattgaagcgaaactacaggaagatctacgcgatgccttggtggattattatctgggacaaattgttcctaatagtaaagatttcaccaatctgaggagcaccattaagaacgttgatgatttatatgatcatttgttactggatacgcaagtgtcggctaaggtcattacttcacgtttatctctggtgacgcagtcggtacagcaatatatcaatcgaattgcacttaatcttgagcctggtttgtctattaaccagcaggaagccactgactgggaagagtttgccaaccgttatgggtattgggccgctaaccagcaactaagaatgttcccggagatttatgttgatcctactttacgtctgactaagacagagttcttctttcaattagaaagtgccttgaaccaagggaaattaaccgatgatgtcgcgcaaaaagccgtattaggttatctgaataattttgaagaagtcagtaatctggaaattattgctggttatcaggacggcatcgatattgagaacgataaaacctatttcgttgcccgaacccgaatgcaaccctaccgttatttctggcgatctctggatgccagtcagcgtaatgctaattcccaagagttgtatccaacggcatggagtgaatggaaggcgatatccgtaccattggaaaacgttgctaacgggattgttcggccgattatgatggataaccgcctttatattagttggtttgaggtggcggaagaaaaggagacggatagcgacggcaatattattgtatcgggacgttatcgcactaaaattcgtctggctcacttaggatttgacggtgtttggagttcgggaacaacgttaagagaagaagtgctggctgaccagatggaagaaatgatcgcggtggtcgatcgcatggaagatgagcctcgtctagcactggttgcatttaaagaaatgagtgaaagttgggacgtcgtatttagctatatctgcgatagtatgctgattgaatccagtaatttaccgactaccactcatccgccaaaaccaggagacggtgataaaggattgtctgatctggatgattacggtgctaatctggtttggttctatttacatgagactgccaatggaggcaaagcggagtacaagcagttaattctctatccggttattattaaccgggattggccaattgaattggataaaactcatcagggagactttggcactgtcgatgatttcacgctgaattctaattatactggcgatgaattaagcctgtatttgcaatcttcgtccacctataaatatgacttttctaaaagtaaaaatattatttatggcatctggaaggaagatgcaaataataatcgctgctggcttaactataaacttttaacgccagaagattacgagccgcaaattaatgctacgttggtaatgtgtgacaaaggtgacgtcaatatcattactggattcagtttgcctaatggcggtgttgatgcaggcggaaaaataaaagttactcttcgggttggtaaaaaactccgggataaattccagattaaacaatttagccaaactcagtatttgcagttccctgaggcgtccagtgctgacgtttggtatatcggaaagcagattaggttaaatacgctgtttgctaaagaacttataggtaaggcaagccgaagtctggatttggttttaagttgggaaacgcagaatagtcgtttagaagaagctattttaggtggcgcggctgaacttatcgatttagatggcgcaaacggcatttatttctgggagctatttttccatatgccatttatggtgtcctggcgctttaatgtggaacagcggtatgaagatgcgaaccgttgggttaaatatttgtttaatccgtttgagtgtgaagatgaaccggcattattgctaggcaaaccgccgtattggaatagtcgtccgttagtggatgaaccatttaagggttatagcttaacgcaacctagcgatcccgatgccattgctgccagcgatcctattcattaccgtaaagcggtctttaatttcctgaccaagaatattattgatcaaggcgatatggaatatcgcaaattgcagccgtcggccagaacgctggcgcgtctgagttattcaacggccagttcattattagggcgtcgtcctgacgtgcagctgactagtttctggcaaccgctcactcttgaggatgcgtcctataaaacggacagtgaaattcgtgctattgaaatgcaaagtcagccattaacatttgagcctgtcgtgcatgaccaaaccatgagcgccgtggataatgatatctttatgtatccaatgaataacgaattgaggggtttgtgggatcggattgaaaaccgtatttacaatttgcgccataacctgacgttggatggaaaagaaatcaatatggatctttatgattcaagtatttctccacgtggtttgatgaagcaacgttatcagcgggtcgttaccgctagaaacgccagtaagatgaacttcaaagtccctaactatcgttttgagccgatgttaaaccggtcaaaatcgggtgttgagactcttattcaattcggcagtactttattgagcctgttagaacgcaaagatagtttgagttttgacgcttaccaaatgattcagagtggcgacctttatcgcttctcgattgatttgcagcagcaggatattgatattaataaagccagtctggaagcattacaggtaagcaaacagtctgctcaggatcgttatgatcactttaaagaactgtatgacgagaatatctcttcgacggaacaaaaagttattgagttacagtcacaggctgccaattcgttgttgatggctcagggaatgagaacggctgccgccgctttagatgtgattccgaatatctatggtttggccgttggtggctctcactggggcgcaccgctgaatgctgcggctgaaattattatgattaagtatcaggcggacagcagtaaatctgaaagcttgagtgtttctgaatcctatcgtcgtcgccgtcaggaatgggagttgcagtataaacaggctgaatgggaagttaattctgttgagcagcagatcaatttgcagaatatgcaaattaaagcagctaataaacgtctggaacaggttgaagctcaacaacagcaggcaatggctctactggattatttctccgaacgctttacaaacgaaagtttatatacctggctgatcagtcaactctccagtttatatttacaagcgtacgatgcggtgctttcactttgtttatctgcagaagcttctttgctatatgagctgaatttgggcgagcagagtttcgtcggtggtggcggttggaacgatctgtatcaaggattgatggccggtgaaacactgaaattggcgttaatgagaatggagcgggtttatgttgagcaaaactctcgtcgtcaggaaattaccaaaacgatctcgttgaaagcactgctcggtgaaagctggcctgcggagctgaataagctaaaacaaaaaacgccaattaactttaatctggaagaacagatttttgttgaggactatcaagagctgtatcagcgcagaattaagtcggtttcggtcagtttgccgatgttagttgggccttatgaagacgtgtgtgcgcagttgactcagacctccagtagttatagcacccgggcagacctcaagacggtagaaaatatgctgactaaaagaacgtttgccgatacgccgcacttggttcgtagtattcaacccaatcagcagatttctttatcgactggggtgaatgatagcgggctgtttatgcttaattttgatgatgagcgtttcttgccatttgaaggttctggcgttgattcaagctggcgtttgcaattcaccaatttgaaacagaatttggatagcctcaacgatgtcattctacatgtgaagtatacagccgcgattggctcatcaactttcagtcagggcgtaaggaaaatattggccaatataaacaacgatgaataa

SEQ ID NO: 73 - DNA, 7554 bp, Xenorhabdus bovienii
atgtacagcacggctgtgttactaaacaaaatcagtcccactcgcgacggtctgacgatgactctcgcagaccttcagcacctttccttcagtgaactgagaaaaacatttgatgaccaactcagttggggtgaaagccattatctctatcgtgaagccgttgaacaaaaaaaacgtcatcgtctgctggaagcccgtattttcacctgtgccaatcctcaattatccggcgccatacgccggggcattgaacaagacgatgcttcacgcagttatgataaaatgtttggctcccgctcttcttcctttgtcaatccgggctccgtggcctccatgttctcgccggccggttacctcacggagttgtaccgcgaggcgaaggatctgcatttcacaagctctgcttatcaccttgataatcgccgcccggatctggctgacctgacgctgagtcagaataacatggactcggaaatttccacccttgcactgtctaacgaactgttgctggcgcatattacccgccagaccggaggtgactcagacgccttgatggagatcctgtcgacttaccgcaaggccgttgacacaccttaccatcagccttatgagactgttcgtcaggtcattatggcgcatgacagtaccctgtcagcattgtcccgtaacccggaagtcatggcgcaggcagaaggcgcttcattactggcgattcaggccaatatctcgccggaactttatcacgtattgaccgaagagattacggaggagaacgctgacactttatttgcgaaaaacttcagtgaaaatatcacgcctgagaattttgcatcacaggcatggatagccaagcattatggccttgaactttctgacgtgcaaaaataccttgggattttgcaaaacggctattctgacaacacctctgtttatgttgataatatttcaacggggctggtagcagacgatgagggtaaactcgacgcttacaagataacccgaattcctggcggagattatgcaaagcacttgaacttttgggatctgctctataaaggtgatagcgatttcgttatcagggccaatttcaaaaaaagtagtggtggtctcacaatacgtaaaagtggagtgggaacgaccaatgatagcaaagttataggtactatctctgcaccaaccgatgcgaatacagtttatcaaagtgaaatattatcaccgcttaccgttgatgatttaaaaaatggggcgacaatatttgcttataatcgtggtggcaataaaaatattgagggaactgctgtctttaccttcgaaagttaccctctgagcatttttgctctcaaactgaataaagccattcgcttatgtctggctagtgagttatcgccgaatgaattacaaactatcgtactcagtgataatgcacagggcatcatcaacaactcggttctgaccaaagtcttctacacgctattctacagtacccgttatgccctgagcgctgatgatgcgcaggtactgaacggatcggtcatcaatcagtatgctgacgacgatagcgtcagtcactttaaccgtatatttaatacgccaccgctgaaagggaaaatctttgaagccgacggcaatactgtcagcattgatccgaatgaggagccagcgacctttgcctgttcagccctgatacgtgggttgggaattaacagcggtgagctgtatcagctaggcagattggcgggggtactggatacaaaaaataacatcacgctttctgtctccgttatctcttccctttatcgtctgaaattactggctcatacccatcagctcacggtcaatgaactgtgtatgctttatggcttttcgccgtttaggggcaaagcaacggcttctctgtcttccggggaactggcgcagctggttatctggctgtatcaggtgacgcagtggctaaccgaagcggcaataaccactgaagaactttggttattatgtacacccgaatttagcggaaatatttcaccggaaatcaataacctgcttaacactctccgaccccgtattagtgaagacatggcgcagggtggcgaccgggagctccaggctgaaattcttgcgccgtttattgctgcaacactgcatctggcgtcaccggatatggcgcgttatatcctgttatggacagataatttgcgaccgggcggcctgaatatcgccggatttatgacgcgggtgctgaaagagacgctgagtcctgatgaaactatccaactggtgcagttctgccatgtgatggctcagttgtcgctttccgtgcagacgttgcgtctcagtgaagccgagctgtccgtactggtcatttccggtttcacggtactgggtgtgagaagtcaacccgccggacagcacaatatcgataccctgttctcactctaccgattccaccagtggattaacgcactgggtaacctcagctctgacacgctggatatgctgcgccagcaaacgctgacggcagacagactggcctcggtgatgggtctggacatcagtatggtgacacaggccatagcctgtgctgacgtgagcagtcttcaaagctggcagaatatcaacgccgtgctgcaatggatggatgtggcctcagaattgcacaccatgccatcggttatccgtaggctggtcaatatccgctacgtgactgtgccgaacaaagccgagtcggatctgccttcctgggatgaatggcagaccctggcagaaaatatggaagccgggctcagtacacaacaggctcaggcactggcagatcataccgcagagcgcctgagtagtgtgctgtgccattggtttctggccaatatccagcctgaagggatattcctgcaaagccgggatgacctgtacagctacttcctgattgataatcaggtctcttctgccataaaaactacccgactggcggaagcgattgccggtattcagctctacatcaaccgggcgctgaaccggatagaatcgaatgcccgtgccgatgtgtcaacccgtcagttctttaccgactgggcgatgaataaccgttacagcacctggggtggggtgtcgcggctggtttattatccggaaaactacattgacccgacccagcgtatcgggcagacccgaatgatggatgagctgctggaaaatatcagccagagcaagctcagccgggacacggtggaggaggcctttaaaacctacctgacccgctttgaaaccgtggcggacctgaaagtggtcagcgcctatcacgataacgtcaacagtgactccgggctgatctggtttgtcgggcaaacacgggaaaacctgccggattactactggcgtaacgtggatatctcacgcaggcaggcaggtaaactggctgccaatgcctggaaagagtggacgaagattgatacggcggtcaccccatacaaagatgtaatacgtccggtggtgttcaaagagcgtttgcaccttatctgggtggaaaaagaggaagtggcagaaaacggcactgacccggtgaaaacctctgaccgttttaccctgaaactggcgtttctgcgccatgatggtagttggagtgctccctggtcttacgatattacgacgcaggtgaaggcggtcactgacgataagcctgacgctgaacggttggggctggcggcatcaggttttcagggcgaagacaccctgctggtgtttgtgtacaaaaccggggagagttacccagattttggcggtagcaataaaaatgtggcaggaatggtcatttacggcgatggctccctgaaacagatggatagtacggcactaagccgctacagcccgctgaaaaatacctttgataccattaacacgaaagataataatttggtaagaaaggccagctatcgtttcgctcaggattttgaggtacccacctcattgaacatgggatcagcccaagacgacaggcatctggtcgtgatagagaacgcggctatcccggagataaccagccaatcttccagtgaaagctttactattacgctgcagaatgcgaccttcaccgtccggtatgacggcagtggcaatgcactcagaagcaaacaaatccgcgccatgaaactcgggggactcgggggtttacctggtgatgactttatactcgccaattcagcccgctatgctggcggcgtcagagacctcggcgggccaatcgcgatttataacaaaacgaaaaactatatcatatcggtacaagactcttatgagccctcccttcatctcagatatctgcgattgagccccattaatgattctggcccaattctaatcagccccgcaccttcttatccgaaagatggaacaaatgtaattgcttatcttggcggcgacaggtcaagtgactttaaaaagtgttactatgcttttgatcgtggaaacaaaaagattgggcccttccaagactggtcatcgtattattcatacggcggctggctggaggttggctcgggggctaaccctgcggggacccagattaccgtcgtggccggcagcaaaccctaccattttaccgccgagaatcatgcggttagtttgccgccaaacagctttgagggcatgcagtataccttcaagcccctggtcatcgatgccgctgggctggtttatctcaataacgcggcgccagtggatatcacctttgaagtggaagggatggggaaaatcagccagaccctgaccgtgagaaaacttgactacggtcaggagaatatcctctgtctgcaagagaccgacaccggtgtgcagtatatgcagctcggagtttatcgcatccgcctcaataccctgctggcacctaaactggtgtccagagcgaataccggcattgataccatcctgaccatggcgacgcagcagttgccggagccgcagttaggcaaaggtttctacgccaccttcaccctgccaccttataatccggcaacgcatggtaccagtcgggcgttcaagcttaaccttaaacatgttgttgatgataacgttcatatcatctactcaggactgctgcaagataccgagcttgcagttcggctctttattcctctggatgatacaccgctttatgagaaattcattgccaaggtgtttttaaccacccagaagaaccccaatgatgttccatgggcaggaccacactttacggatgatagcggtaaaataggtatccatggcagttcgaatgtcagtatgttcactggtgtacaaccccataacggcacaactaccgaaccgctggactttaacagtgcctgcgccctctattactgggaactgttctattacacgccgatgatgtgcttccagcgcctgctgcaggaaaaacagttcgacgacgccaccaaatggatgaactacgtctacaacccggcgggctatatcgttcacggggaaatcgcgccctggatctggaactgccggccgctggaagagactacctcctggcatgccaatccgctggatgccattgatccggatgctgtcgcccaaaatgacccgacgcactacaaagtggccacctttatgcgcctactggaccagctcataacgcgcggcgatatggcttatcgcgaactgacccgcgatgcactgaatgaagccaaaatgtggtatgtgcgcactctggaattgctcggtgacgaaccggaagattacggcagcagccagtgggcggcaccgtccctttccatggcagccagccagactgtacaggcagcctatcagcaggatcttacagcgctggacagtggagaggtttccatgcagccccgcaccgctaactcgctggtcggtttgttcctgccggagtataacccggcgctcactgattactggaaaaccctgcgtctgcgtctgttcaacctgcgcaacaatctatccattgacgggcagccgttatcgctggcgatttacgccgaacccaccgatccgcaagcgctgctcaccagcatggtccaggcgtctcagggcggcagtgtattaccgacaggcaccttgtcgctatatcgcttcccggtgatgctggagcgggcccgcaatctgggggcgcaattgacccagttcggggcttccctgctcagtatggcagagcatgatgatgccgatgaactcaccacactgttacttcagcagggcatggaactgtccacacagagcatccgtattcagcaacggacagtcgatgaagtggatgccgatatcactgtattggcagagagccggcgcagtgcgcagaaccgtctggagaaataccagcagctgtatgacgaagacatcaaccacggagagcagcgggccatgtcgctgtttgatgcggcggcaggtcaatccctggccgggcaggtgctcacagcggcagaaggggtggctgacctggtgccaaacgtgttcggctttgcctgcgggggaagtcgttgggggtcagcgctgcgcgccgcggcgtccgtaatatctctttctgcgacggcttctcagtattccgcggaaaaaatcagccgttcggagacctatcgccgccgtcgtcaggagtgggaaattcagcgtgataacgcggatggtgaaatcaggcagatggatgcccagcttgaagccctgaaaatccgtcgcgaagcggcacagatgcaggtggaatatcaggagacccagcaggcacagacccaaacccaactggagctgttacagcgtaaattcaccaataaagcactctacagctggatgcgcggaaaactgagcgccatctactaccaattctttgacctgacccagtccttctgcctgatggcgcaggaagcgctgcgccgcgaactgagtgacaacggcgtgacctttatccgtggcggtgcctggaacggtactactgcgggtttgatggcgggtgaaacgttgctgctgaatctggcagaaatggagaaagcctggctggagcgtgatgagcgggcattagaagtcacccgcaccgtgtcgctggtgcaggtgtaccaggctctgtcatcagacagcttcagcttgacggagaaactcacccagtttcttagtgaaggcaaaggcagcgcaggcacttccgggaatgaactgaaactcagcagcggccagattgccgcctcggtacggctgtccgacctgaatatttttggtgattaccccgaaagcctcggtcgcacccgtcagttgaagcaggtgagtgtcactttgccggcgctggtcggcccgtatgaagatatccgggcggtactgaactatggtggcagcgtgatgatgccgcgcggttgcagcgccattgccctctcccacgggatgaatgacagcgggcaatttgtgctggactttaacgatgcgcgctacctgccgtttgaaggtattcctgtggatgacagcggtagtctgacgctgagtttcccggatgcgaccgaccggcagaaagagatattgcagagcctgagcgacattattctgcatatccgttacaccatccgttcttaa

SEQ ID NO: 74 - DNA, 2898 bp, Photorhabdus luminescens
atgaatcaactcgccagtcccctgatttcccgcaccgaagagatccacaacttacccggtaaattgaccgatcttggttatacctcagtgtttgatgtggtacgtatgccgcgtgagcgttttattcgtgagcatcgtgctgatctcgggcgcagtgctgaaaaaatgtatgacctggcagtgggctatgctcatcaggtgttacaccattttcgccgtaattctcttagtgaagctgttcagtttggcttgagaagtccgttctccgtatcaggcccggattacgccaatcagtttcttgatgcaaacacgggttggaaagataaagcaccaagtggatcaccggaagccaatgatgcgccggtagcctatctgactcatatttatcaattggcccttgaacaggaaaagaatggcgccactaccattatgaatacgctggcggagcgtcgccccgatctgggtgctttgttaattaatgataaagcaatcaatgaggtgataccgcaattgcagttggtcaatgaaattctgtccaaagctattcagaagaaactgagtttgactgatctggaagcggtaaacgccagactttccactacccgttacccgaataatctgccgtatcattatggtcatcagcagattcagacagctcaatcggtattgggtactacgttgcaagatatcactttgccacagacgctggatctgccgcaaaacttctgggcaacagcaaaaggaaaactgagcgatacgactgccagtgctttgacccgactgcaaatcatggcgagtcagttttcgccagagcagcagaaaatcattacggagactgtcggtcaggatttctatcagcttaactatggtgacagttcgcttactgtgaatagtttcagcgacatgaccataatgactgatcgaacaagtttgactgtaccccaggtagaactgatgttgtgttcaactgtcggaggttctacggttgttaagtctgataatgtgagttctggtgacacgacagcgacgccatttgcgtatggcgcccgctttattcatgccggtaagccggaggcgattaccctgagtcgcagtggtgcggaggcgcattttgctctgacggttaacaatctgacagatgacaagttggaccgtattaaccgcacagtgcgcctgcaaaaatggctgaatctgccttatgaggatattgacctgttagtgacttctgctatggatgcggaaacaggaaataccgcgctgtcgatgaacgacaatacgctgcgtatgttgggagtgttcaaacattatcaggcgaagtatggtgttagcgctaaacaatttgctggctggctgcgcgtagtggccccgtttgccattacaccggcaacgccgtttttagaccaagtgtttaactccgtcggcacctttgatacaccgtttgtgatagataatcaggattttgtctatacattgaccaccgggggcgatggggcgcgtgttaagcatatcagcacggcactgggcctcaatcatcgtcagttcctgttattggcggataatattgcccgtcaacaggggaatgtcacgcaaagcacactcaactgtaatctgtttgtggtgtcagctttctaccgtctggctaatttggcgcgcacattggggataaatccagagtctttctgtgccttggttgatcgattagatgcaggtacaggcatcgtctggcagcaattggcagggaaacccacaatcacggtaccacaaaaagattccccgctggcggcggatattctgagtttgctgcaagcgctaagtgcgattgctcaatggcaacaacagcacgatttagaattttcagcactgcttttgctgttgagtgacaaccctatttctacctcgcagggcactgacgatcaattgaactttatccgtcaagtgtggcagaacctaggcagtacgtttgtgggtgcaacattgttgtcccgcagtggggcaccattagtcgataccaacggccacgctattgactggtttgctctgctctcagcaggtaatagtccgcttatcgataaggttggtctggtgactgatgctggcatacaaagtgttatagcaacggtggtcaatacacaaagcttatctgatgaagataagaagctggcaatcactactctgactaatacgttgaatcaggtacagaaaactcaacagggcgtggccgtcagtctgttggcgcagactctgaacgtgagtcagtcactgcctgcgttattgttgcgctggagtggacaaacaacctaccagtggttgagtgcgacttgggcattgaaggatgccgttaagactgccgccgatattcccgctgactatctgcgtcaattacgtgaagtggtacgccgctccttgttgacccaacaattcacgctgagtcctgcaatggtgcaaaccttgctggactatccagcctattttggcgcttccgcagaaacagtgaccgatatcagtttgtggatgctttataccctgagctgttatagcgatttattgctccaaatgggtgaagctggtggtaccgaagatgatgtactggcctacttacgcacagctaatgctaccacaccgttgagccaatctgatgctgcacagacgttggcaacgctattgggttgggaggttaacgagttgcaagccgcttggtcggtattgggcgggattgccaaaaccacaccgcaactggatgcgcttctgcgtttgcaacaggcacagaaccaaactggtcttggcgttacacagcaacagcaaggctatctcctgagtcgtgacagtgattataccctttggcaaagcaccggtcaggcgctggtggctggcgtatcccatgtcaagggcagtaactga

SEQ ID NO: 75 - DNA, 3285 bp, Burkholderia pseudomallei
tcagcgcgtcggcgaaggccatatagtcggcactcgcgttttgtatccgttccgggtcgacatagtgggcagggaacaggccgagctcctggttggctcgccacagctggtattcgcgatcgatggcccattggtcgaccagcgtgcgcttggcggcgtcgcttgtctcattgcggacagggggattcgacttgaacgttgctggctcggccccttccagcgcgcggttgatgtatagctggatggcgccggtcgcttccagcagttgggtggtgctgatctcgctcgagacgttgacgtcgagcagcaagtaactatagagctgctcggcgttggtgacattttgaacccgtttgtcggggaggattttttcaacaggtagccgacgagggcatcgcgacacgcttcgtcaagcgggtggtccaccgcggttgccaatgcgccgtacctggccacgccggtcatcaccgcatccgctgctgtacgtttgtcggcccatggcaaccgatcgccgtcgcggcttccctcggatccgtacccagtccgcgtggccatggtcttgaccggtttcagctgcgcatagtcaagcgcgagtgcccgggcttgcacgagatggcgatgcatcaaatcaacctcttggaccgtgtcgggcaactccttgaccggcgtgggcaagtcatcgagcatcagcttcagctcctcaaccgggcaaccgagcagctggctcaaggtgtcggtcagcgccgcgatctgcgccgccttcctattgggatcgcgctcggccgcggcggtggcccgtcgcgtgaaatacatgcgccatgcgtcggcgcccgcctggtcgtgttgcaggcccttgagccgccccagcgccagcagcagatcgaaattaagggacaatttctgccgcagagcaccgaacgcttcgggtcgatcgaccaccaggcggatatcctccctctccagccggaacagccgcacagcctcggcatagcggctcatcaacgccagcaacttcagggtgtccgactgttggttgagggtgggtacgtcgatcgcccctttatttcccaggttccacgtcaacagcttgtctagcaccgtgtaataattaatagggtcttttagagaatcttggaggttcatccacgcgagcatcgggatcaccacgtcgctggcgccgctcatccgcttggccaccgcggcgctcagggcggccatggcgctcgtttgcgccagcagcaaggttgcgacgacaccgtccttcatacttgtggctcggctcgcacccttggcgacgagtacgttctgaaccttggtttcaaattctgccttggtgtggtttagcacgagtccgatcgcgttgacggccgcaggtgctttctgcaattcggccagccagtcgatcgtcacaggcgatgttgcgggcgtgtccaacggcaccgtctcataggagtcaaagctcgacgcggtcagcagtgtggggagcaggttctgatgcaggtcgttgatccagttggcggtctcttgggtagccttaagggcctcatcgggcggcgtccggacgatcgtcacgatctgtgcgggtgtcgcctgccacgcggtgagcgtgtcgttcagccatacgagctggtccagcgtgccgagcacatccttgccgccctccgacagcttggtgagctgtatctgtgcgatctgctgcagcatgagcaccgcgtcctgaacagaccagccgaacgaccggaacggtcgggagaagcgctgcagggcggcaacacagggccagtcgaacgcgcggtccatgcggggatcaatcgccccgacgatcgtgtcccagtccgtctgggtcagctgcaggccacgctgcaatgccgcgatctcctccgccgtcaggcgttgacggattggtacatggggattccgaagatatttcttctcctcggagacctcggccgcacagtatcttgcgatccattgcgcagcgtcgccgaactgctggcgcagataggacatttcctgaagcccttcgcgaacaaactcattactccaatacatcagccctacgtaggcgtccacgctgaggccaaaccgtgcgtgccattcccgatagcgggcgatgagcgacagcgcaaaatcgttcaacaaaggtggattgcgattctccaacatggcggcagtacaaatcagatgatcgagctgatggaacggcaggccggtccgtcgatacaggcgcaccatgcgctccatgttgcccaagtactccgtcgtcgtgagcccggtcccgcgcatcagtgccagcttgccttcattcacgcctgcattgactttagccaccctgatggctggcggagtcccccggttaatgtatttggcgtagtacgcagcgactcgatccgggctggcgacgccgtcttccgcgcgaatcccgctgctgcaaatcagaagattcaagtcatccaatgagatcgacgtgtggctcaggaatttctcgacgtcccagagctgcttggcgtcgtccgcacccgctgtcgcagtgagtatcgccatgtcctcatcgcacaggccgagcctgtcgcgtgggttgggcacgagcgcccagtttgcactgaccagcacattggcatcagaagaggtcgcgcgggcgatgccattgaggcttgcgccatccagcgccgccagtcccaggcgcacacgcgtctggtagctatcaaacggcaggctgaaagcgctacgatccgtggcgagctttttataaagctcgtcacgctcctgtgatggcgtcttcgcgagggcttccatcgcctggttcgccagcgacagggtcgtgacttcggtgagcaggtgatcggacgtcaaggccagatctttcaggtcggggcgccgagtctcaagccgacgctgttcatccgtgggggtaatctgcttcgttgccgtgccgtagatctgcatcaagtagcgggccggcgagagcttcgactgcagtgagtcgggatcgcagaattcgcctgtctcgacgggcaggttccggagttccggatcaggttcgtggaagtggggcgaggcgcgcgtggtggggtcgtggctgacccaggcgtcgcgcacggatgcgcgcacgatcgcggcggcctgcacgatctcgtcgcgccatggcaccaggtccgttggcagggcctcggactgcgctagggcggccgcctcctgcacactcatctcacctgcgtcggccagtgcgtcgcgcagggattcgctgagatactgggtttcaagctgctcttcaagtgtgctcac

SEQ ID NO: 76 - DNA, 7659 bp, Burkholderia pseudomallei
ttatcgcaggatcgtgtagcgaatatgcagcacgatgtcgttcaacgtccgcagcatcgcctcctgcttgccgagcgcgttggggaaagcgagcgtaagcgtaccgacatcgtcgacgggaatgccctcgaaaggcaggaaccggccgtcattgaagttcagttcgaattgaccgctgtcatccaggccccgcgacaccgccagtgcttcgcagccgcgcggcaatacgatactgcctccgtaagacagcacggcctgaatgtcctgatacggcccgatcagcgccggtaagctgacgctcagctgcttgatgcggcgcaggctgcccagttgcatgttggccgggtagtcgtccacgagcttcaggtcacgcagcgtcacagtcgccgacagccgaccgttctcaagcaataagctgttcgcgtcgctgcccgcccgaccgcctttctcttcgataaaggtgaccaccttctctgccaaatcgaattgcttatcgtcgggtaacccggcatagaaatcggccagcgaaaccgtacgcacgacttccaatgcacgcgcgtcctgaattaggtaggccgcctccatctcagccagattccgcataagttcctcgccgcagagcagcccataatacgcatcctgccatgcgccccgcttgatgaagctgtcaaccttgtgagtttcccattggaaggcctgctccgccatcacacaccgcgcaaccgccaaatcggaaaactgggagtaaatcgcaagcaggcgaccgcgcatccaactatacagtgccttactactgctttttattttcagaaactccagctgcgcctcggtctgctcctgctgtcgctgcagataatctctctgcagcatcgccgcttcccattgatggcgcaatgtagtctgttgcgccttaatttgatctacatcggcttgcgcgttcttcgcctgaatgtcccactcttcgcgacggcggcggtacatttcggactggcttagctggtcagccgtaatcatcgttactgcggcgctcacttgcgcgccgaatgctgatgcgttcagcgccgccccccatcgtgagcccccgatcgaaaagccaaagatgttcgggaccatttcggccaacgcccccgccatttgcagggctgtcgcggtagcggtgatggccgatgacgacgctcgcaaacccagcaccgcctgctcgccactattgatgttttcgtcatacagcttcgtgtagtggttccgccgctgtgtcgctgcctccattgcctcagtcaaagcgagaatactcgagtccacttccgccagcctctggtcctgctcgctcagagagatcagtaccaagtccttggcctggttttgcagcagctcactgagtgcctccgcgtcctgacgctcgatgatgccctgcaggctgctaccaaactgcatcaactgcgacaccgtgctcttggcgttctccagcatctgcgggaatcgccacaacgtcaggtagctcggcgggagcggcttgcctccggacgacgccgacacggccgcactctgcagagccttcggattggcgggggtggcatatggcgcgagcgagagcggctgcccgtcgatcgaaaggttgtggcgcagattgtagagccgctgttcaagcgttcgccaatagccctgcagcacgtcgttggcctgcggcaggaacagcgccgtcagcgaattggcggtcagcggggcgggctgtccgccggccgataaggcttctagtgcctgcagacgggccaattgcgccgtctcgtcagcggccgccgcgagggacggctcggaccattccgcagcgcgcggcagatacggttgttcgcccagaagctgcaaggcctgcacataccacatcttcgcttcgctcagcgtgtcgcgctcaagctggcgataggcgcggtcgccacgggccagcagcagatccagccagcgcatgaaggtcgcgaccttgtagtgcatcgggtcaacttgcgcgatcgcatccggatccgtgctgtctagcgactcggcattccagccgaggtcttcttccaatggccggacattccactgatagtcctgcagcagcccttctaccacgtagccggccggattccatacatactgcagccagcgctgtgcttcatcgaagcgctgctccaccagcaaccgctgcgcgaccagcatcggggtgtagtagaacagctcccagaagtacagcgcgttcgcgccgccaaagtccatcggttcgatatagattggatcaatctggacgtcggcatcccgaccgctggtccagcccgagtccttgacaaagtcggtgggcttgagggtcgccggatcgaatcggagttgccccgccttgaattggccacgctgacacgcgagtaccacgccgaggcccgtgctcaaatccgccgggaaatccagcgcatcgcctgcgcgcacttgcgagaccggcacgaaaagcatgtggtgctgggcgatatctgtcagcgatgcatttaagaacgcaaattccgctggtgccaaggcggcgccgctttgcagaacaagtcgtacaccccttgtcgagccatgcaccgtcgggttataggccggcagtgtcacgttgacgtagccgccctcgccgagcgggggctcggcgagatactgggtatcgagagtcatgattctatcgagccccacggctgcacgttcgatcagctgacgagcgaacagggtgttcaggcgtacccggtagccctcccactgcatgtactgggcgccgttgttatcgcgatgcaagctcagcacatttgaagttccttcgacaatcctgactactggaatggagaaaaattctttgcctgctagctgaccgtcggcaaacttcgcttcgcaggtaatatcaacgcttgccctattatcgacataaatcagacgactggcgtcaacggttagtttctcgaatgagaaattcattgcgtaaaggctgggtggcggaagattctcaacatgggcatccgcggaaaaatgctgcgatccgcctccagccacacaggaaattacgactttgtcaggcggaatttttgtgttcaagtctgcggatggctgtatcccagcgtacgagtaagttacgtagtgtccgtagtcgtcaaattgcacttgtattgaattcgccaagtctgccggaacatttccaaatgaatatattcctatcccgttgtaagtgatccgactcgcattgatgctactgcccgtataccgaatttgaatggctctatatggcctcaaaggatctggagaagggcctacatcaacgtggtttgagacaacgaaggtggaggttccatatttgcccacaggcccatagcactgggtcgaatcgttgtaaaggataaccctatcccctgcctgaaactgacgctgcatggtataaagctgcatgtatgccatgttgttaacactcttggtcacatcaaatgtgacgcccagcgagatggcgcatttaatatataatttatccagagacgactcatacgtgatgccagcaatttttcctccaaatacacgcgaaatctgatgcgccccccattcaaaccccgaattgaccgttaccgaatacggaatttggtagtgctcgccgtagcgattattgacacgccggcgattcggcgtatcgaactgggcatgcacgttgtcgcgatagtattggctctgctccgtcgtcagatcccgtgaggacagatcctgctggatgaccagacccgccacccgtgcagcgttcgcggtaccctggatcttgtaaaacagcaccagcaaggactggtgggtggggctttccgcgcaatacaggcccggcgcctcgtcatcggccagttgcagtttagccagcgtggtactcacctcgtaagtgagcggcgccgaccaggtcccgtcgtaacgcaaatacgccagcttcagccaatattggtacgccacttcgttgataacgtcctccccctcggctttcgcctcggcccgctcggtccgctccagccacaccaggtacagacgcgtattgcgtacgaccggacgtatcacaccatgatatggtttcaacgcacagttgatcgcccgccactcgctccacgcattggccgcaaactgcccgtcatggcacttgttgtgatcgacgctccgccagctgaactcggcctcgctgctgcggttactgcccacaaagtacgtgagcccctggtccacgttcacattgtcgtgatacgcgctgaccacgtccagatttgccacctgctcgaacgccgtcaggtagatgttgaaggcatcatcgaccgtatccgctgtcaggtatgcctgattcaccgactgcagcaaattattcatcatacccgtctgcccgatccgcagcgtcggatcgatgtaattctccgggtagtacaccaactgtgaaacgcctgcccaggtgctgtagcgcttgttgtacgtctcccagtcggcaaagtactggcgggacgacaccgcggtgaggacttggggttcgctccggctcaacgcacggtggacatacagctggatgctggccatcgcctcggcgatccgggtcgtcttgatctgggggctcacctgattgtcgatcagcaagtagctgtacaggtcgtcccgggtgcgtaaattcagcgtcggatcggcgacttccgccaggtaataacccgcgagcgtcgcggcgagcgattccgccaccgtgcccgcaaccgtatcggcctggtcggcgggcaacgcggccacgaatgaagtggccacccgttcccactccggatacgccagcaccgccgcgtcggccggccgtatgtaatccagtgccagccagtcggccacgcccttcggcgccacacccagtccgttcgccagattgatccactgcatcacgacatcgatttccggccaggtatgcaggagttccgagtcctcgatctgctcgtgctgcgccgcctgtttgcccgcctgccgcagcaactgctcgtccagtgccatggcctgggccaactgggtgggggtgagcgtgtcgacctcgaatgcgctcaagaccgtagcagcgttgcccgccagtcgcccgacccattccgcataggcggtgagctgcatcagggtgcgcgcgtcatggccggccacggtcgcgccctcgggcagcgtgacgaggctgtccggctgctcgaccagccggcggaacgagttcgcatcgagaccggtagcctgatacacgagcgctagttgcgccagcgcgtggcaaaactggatggcagcggccggcggcggggcgtgatttgccacagccgcccaaaacgcgtcgacgcccatgccattcggctgcaactgatccagccagagcagtacggcgcacgccacttcgttcgaggtcaaacgcaatgatgctgcgacatagggcgccatcgcctcgatcaactccccgtcgttcaggtcggcgtccggcagcccgttgttgagtgcctccagcaggttttggatgtccggcgtcagcgtatcggcatagaccgtcgtggtcatcacgaacaggtcgtatgggttccacttcatgtcgttcagccagcgcactgccgtccccagtcggcgcagcagaccgtacaacgcttcatcaccgatcccgatcagcctagtcgcagtttctccgagtccggccagcagcagcgccaggtcgtccacgctcagccgatgcacgtcagccagcagatgtgcgcgatacagggccgacaaatggcggaggtcgttggggatcgtgccgtcctggttcccgggatcggccataagcaacaagcggtacaacgccacatcgtcgacctgaaacgcgcgtttcaacactgctttgcgcagatcgtcgccctgactgtccggcttcaggtcaatccggggaccgcccgtgccgaacacataaccgttcagcggcgggctattgaacaatcggtcgaactggctggactgcccgccgaatcggagccgtgaaatgtcgccattgcacaggcacagcgcccgatcatggtcgatcgcattacgttgcatggacgactgcatctcgagcatgcgccgcaccgccgtctcgtccatggtccagtcggcgtgcacgctcgcggcggccgcatcgaccgcggcaggcgccagtccggtggccttgtgcgcccggatggacttgttgatttccagcagaacattcttatctagattgaggccgagggagaagtgtgcagtcggccagaggagcaacttcccgctggaatcgtaacagttcagtgccacacttgcttgctgctgctgatcttgtggtatttctatactgacgggcaactggtactcgtgatccgtcttcccggcgttgaactgttcatcgacaaaaatcgattgccacccaccaacattcacactagtgaaaacctctaacctggctgccgttgagggcacgctggcgaagctgaagcgcagcacctcgaagacgttactgtgttgggcaggtatcagttcgatgtaatgtacactttgcgctgtcgcatagctgcgactcacatgcaacagggacagattgccggcctgatccattttcggatacgctaaccgggaaagtgaattcgtccggttttggcgatagcctttgagcgcatagttttcaatgaactcagtacagaggtcatccgagatatcatagtattgggcaagcgcgcggaccttcagtagctcgttcactgagatatttccgaaattgcgctcaaactcctgatccgcagagtgatccggaagcttcaccgcctcgatcagaatcgcatagagttccggggtgatcccggcgcggaaccccagccgcgatgccgccgacatcaggcccgcgacgtccggcgccgttccctcgtgttttccctcagggtccagagtcaacaatgctcgccgcacctgttcgaacgcttcgttaaacggcgtcgcgcccttcgtgcgccaggtcgccagccgttgcgggaccgactcgtcgccggtcaaactcgtgtcgtgtgcacggatggcagcctgcagtatctcgttggacaggtctagcatcgacagcgattcatccaggttgctctggctcagcacaagtgtggcaaggtcggggcgacggacacccagatggtaggggaagttcgcgtagtgcagcgcccgcgcttcccgatacatttcggtgagataggcggccggcgagaacatggaagccaccgagcccggcgcgacatactggctcgcgcgttgcccgagcatgctttcgtagtcgtgcaactggacacgcggcggcgcaatcgccaaacccactgcttgcgacaactgcggattcgaccgcgacaacaacagggcttcgtatagcctgctttcgttgagggatctctgcgctgcccggtacatcacccgcgtttcgtgccaacttagcacgtccctcaccttattccgaaactcatcgaacgaaaacagcgcaatctcaatgagtgtcttgataccaagcggttcgattgacgattggagccgagacaacgtctgggtattcacaacatcacctcgcgaaaaggcttgcgcattgagacgcgccaggcattgttcaatcgctctatcgaaagctaaagtcacctgacggagcaggtaattgcccac

SEQ ID NO: 77 - DNA, 3594 bp, Yersinia pseudotuberculosis
atgcctactagcactgtattaaataaaattaacgaatcgcgccgcgacgcattggttaactactatcttgctaaaaatgtcagcggtgatgaggaaattaaaaccgcagaacaactgtatcaatatttattattagatactgaaattagccatgaagtaaaaacttcacctattgccgaagcgatcagtagtctacaaatttatattaatcgttgtgttgatggagaagaaattgaacttcatgaaaaaaacatcagtaaacatttcagcactgataattttttgcataactggaatatctataataaacgctatgcacgctgggcaggtaaagagaagctgatgtattatgcggctgactatattgaccccactttacgctataataaaactgagctatttaatacctttgagcaaagcattaataacagcaaattgacagaaaaatcagtaaaatcagcattgcaaagctatttaatcagctatgaaaaattgtctcaaatagacactatcaaagagttatatgtagaagatattaaaacttattttttcctcggtaaaacccgagaatcaccttgccaatattattggcgtagtagtgaaaaattgtctaatgatagtaataatctacactggtctgaatggagaaaagttaattgcaacatcaatggtacagaaaaaaaattctttattaatcttagttggcatcgaagtggcctttatattgactggattaatacattttccatcaaggccaataaagatgaaaccacagagaaataccattacaatcgtgtatacaaaaacgatggtaatacttggtccgaactcattatcaatatggatataggatttaaattgagatcctcaagcgaggttgtaacattgcctcctttctttgtaaatcaaggagatccaaactctaaagaagaagttgaaaatttatttttaactaatggaactagcataaaaaaaatagagtcacgtattcatggctatatcaatggtgacattaaaatattatgtaatgaagataacatatcattcgaaatagcggaaaaactcatcaacgggaataatggaacaatcagcgacattaaattaattgagaatgggaaagagatattaatcataaaaaatgaaaagggggaaaagaaagaaataaaattaatagataaatttgaaattaaaatatttccatataatgaattagtagccagttctattgtattcaatagaataaaacctgaagaaaaaataataaatgaattggaaaataaagtttctttattatcaccaaatagtctaccattaaaagaaaactttcaaaagtcagttgatgaactgctcagttatagcacccaaaaagataaagtaggattagacgcattcaatggctcttacggcatttatatatgggagttgttcttccatattccattactggcatctatgcgattcttaaatgaacagcgttttgatctggcacaacactggttaaaatatctgtttaatagtgccggttatcgtgatgggaatggtgatttgctaaaggaaggcgataatatcctttattggaacagtctgccactgcaacaagataccgattgggataaaaacacgctaacactgccaaccgacgacccagatgttattgccatgcaagatccgatgcaatataagttggcgatctttatgcgtacattagacttaattattagccagggcgatcaagcttatcgccaattagaacgagatacactggcagaggctaaaatctattatattcaagccagtcaattattggggccacggccagatcttaatcatggtcataagtgggaaaatataaaattagcagaagaaagtcaccaatctgagaatggtcatttcctgccaccgtataacgaaattttattatcctattgggataaactggaaattcgcttatataacctacgccataatctaaatttggatggccaaccattacatttacccctatttgccacaccagtggatcctaaagcattacagcgtcaacacggggccggtaatggcatcaatagtggtgagcaaatggcaacagcgcaaacctcgctgtatcgctttccactgttaattgagcgagcaaaaagcgccgtcagttcggtgattcagttcggcaacagcctgcaaagcgtactggagaggcaggataacgaagccatgaccctgttgttccagcaacaacagcagaaagtcttgcagcacactaaaaatattcaagacaacaatatcctcgtcttacaagctagcctggatgcgacaagttcactgaaaagtgcggctaaacaacgcagtaaacactacaaagagctgctggataacggtatttccagccgtgaacaaagtggccttgatctccgtattgacgctggagcggtcaatattgcatcagtcgcccccttaatgctcgctgccgctttagataccgcacccaatgtatttggtctggctgacggcggttctcactggggagcggtgccatacgcgacctctgcgacactgcaaatcagtgccagcttaaccgaaagccgcgccaatattaatgatatcaaagccaattatgaccgccgtgaacaagagtggacactgcaaaaaaatcaggccgataaagacgctgaacagttagcgcaccaatataccagcgtgcaggaacagctcaatatggcgcaaaaacaacgtaatctggcggagttggagcaaggccatgccgatgcactgtatcagatgcaaagcacccgttttactggcaaagagttatacaactggatggcaggccgcctctcaggcctctatttccaactgtttgatgccactcaacccctgtgtttaatggcaaaggcggcactggaaaaagaggtcgataaagcgaaaaccgatggcttatttattcgctccggttggaatgatctctatcaaggactattggcgggtgaagacctgcaactcaatctgcaaaaattggaaaatgtgtggctgatggaagaacagcgggcgctggaagtggaacgcaccgtctcattggctcagcattatcagcaattaggtgaccataagttcgatctggcagaaatcgtcacgggctatatggcgcaagataaaactgaaaaagccggtaatgaacaagacggtgtggaattaaaaggtggcactttaattgtctccctcagcatcaatggcctgaatctgatcgaggattatccggcaaccatgcatttaggcgatatccgccgtatcaagcagataagcgtgagtttacctgcgctgttaggtccgtatcaggatatccaagccactctcgattatgcgggtgaaaatacccatctggcgaaagggtgtaccgcgctggcgatctcacgtgggatgaacgatagcggccagttccaactggactttaacgacggtaaatacctgccgtttgaaggaattgatatcagcgacaagggcacattggtgcttcgcttccccaatgcaaccggcaaacaaaaactgctgctgcaaagcctgagcgacatcattttgcatattcgctacaccatccgttcttga

SEQ ID NO: 78 - DNA, 3594 bp, Yersinia pestis
atgcctactagcactgtattaaataaaattaacgaatcgcgccgcgacgcattggttaactactatcttgctaaaaatgtcagcggtgacgagaaaattaaaactgcagaacaactgtatcaatatttattgttagacactaaaattggccatgaagtaaaaacctcacctattgccgaagcgatcagtagcctacaaatttatattaatcgctgtgttgatggagaagaaaatgatctccatgaaaaaaacatcagtacacatttcagtagcgataactttctgcatggctggaacagttataataaacgctatgcgcgctgggcgggtaaagagaagttaatgtattatgcggcagactatattgaccctacattgcgctataataaaactgagctatttaatacttttgaacaaagcatcaacaacagcagactgacggaaaaatcagtcaaatcagcattgcaaagctatttaatcagctatgaaaaactggctcaaatagatactatcaaagagttgtatgtagaaaatattaagactcattttttcctcggtaaaacccgtgaatcaccctgccaatattattggcgtagtggtgaacaattgtctaatgatagccatcatctacgctggtctgaatggaaaaaagtcaattgcaatatcaatggcacagaagaaaaattctttatcaatcttagttggcatcgaagtagtctttatattgattggattaataaattctccattaggaccgataaagatgaaaccacagagaaatatcattacaatcgtgtatacaaaaacgatgataacacttggtcagaactcattattaatatggatataggatttaaattgagcacctcaaccgaggttataacattgcctcctttctttgtaaatcaaggtgacccaaacgctaaagaagaagttgaaaatttattcttaactaatggaaccagtataaaaagaatagagtcacgtcttcatggctatattaatggtcatattaaaatattgtgcaatgacgatggtatatcgtttgaaatagcggaaaaacttatcaatggagataatggcaccatcggtgaagttaaaataattgagaatgaaaagataatatcaactataaacaatgaaaagggagaaaataaaaaaataaatctcatagataaatttgaaattagaatatttccatataatgaattggtagccagcactattgtattcaatagaataaagcctgaagaaaaaataatcgatgaattagacgataaaatctctttactatcaccgaatagcctgccattaaaagaaaaatttcaaacatcagttgatgagttactcagttataacacccaaaaaaataacgttaaattaaatgcattcaatgggtcttacggtatttatttatgggagttattctttcacattccgttactggcgtctatgcggttcctaaatgaacaacgttttgatctggcacagcactggttaaaatatctgtttaatagtgccggttatcgtgatgggaatggcaacttgctaaaggaaggcgataatatcctttattggaatatcctaccactgcaacaagataccgcttgggataaaaacacgctaatacaggcaaccgatgatccggatgttattgccatgcaagatccgatgcaatataagctggcgatctttatgcgtaccttagacttgattattagccaaggcgatcaagcttatcgtcaattagaacgggatacgctggccgaagctaaaatacactatattcaggccagtcaattattggggccacgtccaaaccttaatagtagtcatcagtgggaaaacatcaaattagcagaagaaagtcgccaattggagaatagtcatttcctgccaccctataatgaactgttattatcctattgggataaactggaaattcgcttatataacctgcgccataatctaaatttggatggccaaccattacatttacccctctttgctacaccggttgatcctaaagcattgcagcgtcaacacggggccggtaatggcatcaatagtagtgagcaaatagcaacagcgcaaacctcgctgtatcgctttccactgttaattgaacgggcaaaaagtgccgtcagtgcggtgattcagttcggcaacagcctgcaaagcgtgctggagaggcaggataacgaagccatgacgttgttgttccaacaacagcaacagaaagttttgcagcacactaaagatattcaaaacaacaatatccaagtcttgcaagccagcctagaagcgacagattcactaaaaagtgctgcagaacaacggcgtaagcattataaggagctgctggataacggtatttccagcgatgagcaattagcgattaatattcgtattgcctctgcggccctcaatggtgagtctctcgtccccttggggcttagtgctgttttggatactgcgcccaatgtttttggcttggctgacgggggttctcgctggggggcgatatcacaagcggttggctggggaatgcagagtatggctatggccctagaaaccaccgcgggtgtccgtgatgcaaaagccaattatagccgtcgcgcacaagagtggaccttacaaaaagatcaggcggataaagacattgaacagttagcgcaccaatataccagtgtgcaggaacagctcaatatggcgcaaaaacagctgaatttagctgagttagagcaaggccatgccgacgcactgtatcagatgcaaagcacccgttttaccggcaaagagttatacaactggatggcaggtcgcctttcgggcctctatttccaactgtttgatgccactcaacccctgtgtttaatggcaaaggcggcactggaaaaagaggtcgataaagcgaagaccgatggcttatttatccgctccggttggaacgatctctatcaaggactactggcgggtgaagacctgcaactcaatctgcaaaaattggaaaatgtgtggctgatggaagaacagcgggcgctggaagtagagcgtaccgtttcattggcacaacattatcaacagttaagcgaccataagttcaatctggcagaaatcgttacgggctatatggcgcaagataaagaccaaaaaaccggtaatgaacaagactttgttgaattaaaaaatggcaccttaattacctccctcagcatcaagggcctgaacctggttgaggactatccggaaaccatgcatttgggtgatatccgccgcatcaagcagataagcgtgagtttacctgcgctgttagggccgtatcaggatgttcaagccactctcgattatgcgggtgaaaatacccatctggcaaaagggtgtaccgcgctggcgatctcccgcggaatgaacgatagcggccagttcctactggactttaacgacggtaaatatctgccgtttgaaggaattgatatcagcgacaagggcacattggtgctgcgcttccctaatgcaactagcaaacaaaaactgctgctgcaaagcctgagcgacatcattttgcatattcgctacaccatccgttcttga

SEQ ID NO: 79 - DNA, 7131 bp, Serratia entomophila
atgaggcaagacattatgtataatattgatgatattctggagaaagtgaatgctccacgagcacgcctgtcagaagaaaacgatacagcggtgacgctgacggatttattctcgcgttcgtttcccgaggtcaaaaaaatcactggcgacagcctgtcatggggagaggtctgctatctgtacagtcaggcgcagcacgaacagaaagaaaaccggctcaccgaatcccgtattctggcccgggcgaatcccctactggtgaatgccgttcgcctgggaatacggcaggcagccggcagtcgcagctatgatgactggtttggctcccgcgcagaccgtttcgcccgccccggctcggtggcctccatgttctcaccggcggcgtatctgaccgagctgtaccgtgaggcgaaggacctgcatccggacacctcgctgttccggctggacatccggcgtcccgacctggcggcgctggcccttagccagaataatatggacgacgagctctccaccctgagcctgtccaatgagctactgtatcgcggtatcggggcagcggaagggcttgacgacgacagcgtcagggagctgctcgccgggtatcgcctgaccggcctgaccccctatcactgggcgtacgaggcggcccgccaagccattctggtgcaggacccgacgctgatggggttcagccgtaatccggatgtggcgcagcttatggaccctgcctccatgctggccattgaagccgatatttcaccggagctgtatcagatactggccgaagaaattacgacagacagttacgaagcactctggagtaagaattttggtgatatgcctccctcctcactgttatcttatgatgcacttgcaacattttatgatcttgattacgatgagctaacttcgttattgtcattaaggctggacttttcaaatccaaacaatgaatactacattaatagtcaattaagtgtcgtaactctgaatgaaagcactggtttaataactatacatcattatttaagaacgctaggcggagactcacagcagattaaccctgagcttataccttatggggatggaacatatctttataatttcagcgtggtgtcaacgatatcagaggatagtttcaaactagggtcgttaggttctaacagtagcaatctttactctggggattatcagcttcaaaaaggggttcgctatagcattcctgttgaaatagatgaaggaaagttaaatgatgggatcacaataggattgagtaggaaaggggggggatattactcaacagtaaacttcactctgattgaatatgatcctgcgatattcattcttaaattaaataaagttatccgcctatacaaggccacgggcatgaccacggcggaaatatatcaaatcaccaatattcttaataacggtctcaccattgaccatgcggtcctgagtaaaatcttcctggtccgttacctgatgcgtcactatcagcttgatgtggcccggtcactgatattgtgcaacggaaccatcagtgaccaggcgttcagcggcgaaaccggcctgttcaccacgctgttcaacaccccaccgctgaacggccagctgttttctgcagatgatacccccctcgacttacgctctgaagcaccggaggatgctttccgtctcagcgtactgaaacgcgcatttaacatcagcgcctcggggctttccacgctctggcagttggccagcggtgacagcagcgctgggtttagctgctctgctgacaatatcgccgcactctaccgagtgaaactcctggctgacatccacgacctatccgctggtgagctgtcaatgttgctgtccgtctcccctttcagcggggtggccgccggctcgctgtccgataatgagctgacgcagtttctgtaccagaccaccacctggctcacggagcagggctggacggtcagcgatgtgttcctgatgctgacgacgcagtacggtaccctgctgacccccgacattgagaacctgctcgcttccctgcgcaacggactgtcgggccgtgagctgttcccggaaacgctccccggcgatggcgctccctttattgccgccgccatgcagctggacgccacggatacggcgaaggcgatgctgacttgggcggaccagttgaagccagaggggctgacgctgacggaatttattcttttggtgatgaatgccgccccaaatgacgagcaggcgggccagatggcagggttctgccaagccctgtggcaactggcactgatcatccgcagcaccggcctcagcacgcgcgagctgacgctgctggtcagccagccgggacgcttccgcacaggatggcaccatctgccccatgacctgccggcgcttcgcgacattacgcgttttcatgccgtcgttaaccgcagcggcagccatgccggggaggtcctgaccgcacttgagaccggagaactgtcgtcagccctgctggcccgggccctgtcacagaatgagcaggatgtgaccggcgccttggcgcaggtgaggggggccggtgaacaggacaacagcgtgttcacctcctgggaagaggtggaccaggctgagcagtggctggacatgagtgagaccctgtccattacgccatccggtctggctagcctgattgccctgaagtacatcaatgtgtccgatgacagtgcaccgttgtacagccagtggcaggtggtatccggtctgctgcaggccgggctgaaaagcagccagagctcggcgctgcacgattatctggaggaggggaccagcagcgccctttgtgcgtattatctgcgtaatctggcaccgaacatggtatccgggcgcgatgacctcttcgggtatctgctgctggataatcaggtgtcagccaaggtaaaaaccacccgcattgcggaggccatcgccggcatacggctgtatatcaaccgggcccttaacggaatagaactcagcgccatggcagaggtgagggggcgtcagtttttcactgactgggatacgttcaacaaacgttacagcacctgggcgggcgtctcagagctggtttactatccggaaaactacctcgacccgacggtccgtatcgggcagaccggcatgatggacaccctgctgcagtctgtcagccagagcagtatcaaccgcgataccgtggaggatgcctttaaaacctatctgaccacgtttgagcagattgccaatctgaacactgtcagcggatatcacgataacgccagcatgacgcaggggactacatggtatgtgggtcgcagcatcacagatcagactaactggtactggcgcagcgccaaccacagcaaaatccaagactcaatgatgcccgcgaatgcctggaccggatggacaaaaattaactgcggaatgaatccgtggtcagatcttgtgtgctcggtgtttttcaacagtcgcctttatgtcgtctgggtcgaagagaatcagtctgctgatacggaggcagagagcacgacaaccacgcagcagagctacacgctgaaactgtcgttccggcgctacgacggtacatggagttccccggtgtcgttcgacattaccggcaacatcgcatttccggaaacgcagggcatgcatgtgacctgtaatcccctgactgagcagctctattgcgcgttttactccgtcaccagcaagccggactttgataacgctcagctgatttctgtggataatgatatgacgctaaatgtcatctcagatatagggatttttaagagcgtcagtcacgaatttaatacgagcactgagaaatttattaataatgttttttcagacccttccgctaattattttgtcagtgcaacgagtttaattgatgatgttatccacagcgatttctcactccttaattctaaaactacaagtactgtttttactaatgaagattcctctcttttgacgccagagcttcatattacagcaaatgtttcgtgttttgttagtactgctggcatcgccactcaatctaccatagaaaaattcgttcaggcagggatagaatttgaggaaattaatttttatgcaggccaggccgccggcggatttgacggatttgtgggagtggatgtttctaattcaaaagtataccaggtcggaaaagaagcagttggtgtcactgtaaaatcttattccgtcactggcgttagtggttctgttgagttatttattgattcatcaaataaatacttcagcggaattttgtcagataaaatgataaccgctttaattagcggcagtacatcaaaagttaattacgtgtcgtctattggctctcaagatttttggagtgtaaagtcgctcatgccggcacttcagatatatgaattaatcgatgatatcatactgacatccggcgtaaatgggactgaaattaaatcctggccttccgctgaatggtataatgataagctgagtctgcaatccgggaataatcttttcaacaccaaatcgctgagttttaccgttaataccagtgatattgttgaagatgagtttgacgtgacgtttacgttcaccgctgtcgatcagaataacgtcgtgctggccgcccggacggccatattaaccgtcattcgaaacattaataatgacacttccgttatcgcattacgtaaaaatacgcgtggcgcgcagtatattcgtttcactgcgggtaacgatgtggcgcttattcgcctcaacaccctctttgcccgccaactggtcgaccgggcgaataccgggattgacaccattctttccatggagacccagaggcttaccgaacccgccctggaagaggggagtgatgtgtttatggacttctccggagccaatgccctctatttctgggagctgttctattacacgccgatgatggtgttccagcggttgttgcaggaacagcacttcccggaagccacccgctggctgcagtatgtctggaacccggccgggcacgtggtaaacggggtgctgcagaattacacctggaatgtccgtccgctggaggaggacaccggctggaacgactcgccgctggactccattgaccccgatgcaatagcccagtacgaccccatgcattacaaggtcgccacctttatgtcgtacctcgacctgctgattgcccgcggtgatgccgcctaccggctgctcgagcgggacacccttaacgaggcccggatgtggtacgtccaggccctgaaccttctgggcgacgagccctatatttcctttgacgccgactggtcggcgttgaccctgggtgacgcagccagcgaggtgacgcgacgcgattaccaggaggccctgctggccgtgcgccggttggtgcccgctcccgagacacggacggcgaattccctgacggcactgttcctcccgcagcagaacgaggtgctcaaaggctactggcaaaccttggcacagcggctccataacctgcgccacaacctctccattgacggccagccgctttccctgtccgtctacgccacgccgtccgaaccgtccgccctgcagagtgccgtcgtcaacagcgcgcagggtgctgcagcactgccggccgcggtgatgccgctttacagtttcccggtcatgctggagaacgcccgggggatggtgagcctgctgaccgggttcggcaacacactgctcggtattaccgagcgtcaggatgcggaggcgctggccaaactgctgcagacccagggcagtgaactgatacgccagggccttcgccagcaggataacgtcctcgaggaaatcgatgcggatattgccgccctggaggagagccgccgcggcgcgcagatgcgttttgaacgttacaaagtgttgtacgaggcggacgtcaacaccggcgaaaaacaggccatggacttgtacctcagttcgtccgtgctgtcggcatcaaccgccgcgctctttttggccgaggccgcggccgatatgctgcccaatatttacgggctggccgtcgggggctcccgctatggggcactatttaaagccaccgccatcggcatccaggtgtcctccgatgccacccgcatatcagcggacaaaatcagccagtcggaagtgtaccgccgtcgccgggaggagtgggaaatccagcgtgatagtgcgcagtctgacgtggcgcagattgatgcccagctggcggccatggcagtgcgccgggaaggggctgagctgcagaaaacttaccttgagacccagcagacccaggcacaggcgcagttggcattcctgcagagtaagttcaacaatacggctctgtacagctggctgcggggcaggttgtccgccatttattaccagttctatgacctggcagtatcccgctgcctgatggcgcaacaggcctggcagtgggataaattcgagactaggtcgtttatccagccgggggcctggatgggggcaaatgccggtctgctggccggggaaaccctgatgctgaatctggcgcagatggagcaggcctggctgacgggggatgagcgggcaatagaggtgacgcggacggtctgcctgtcggaggtctataccagcctcgcggaggatgcggcattctctctggccgacaaggtggtggaactggtcagtaacggttcgggcagtgcgggtacgaaaagcaacggattacagatggatcaacagcaactcgaggccaccctgaaactggctgacctcggtatcggcaacgattacccggtctcccttggcaccatgaggcgcatcaaacaaataagcgtcacgctcccggcgctggtcggcccctatcaggacgtccgtgcggttctcagctacggcggaagtatggtcatgccccggggttgcagcgcgctggcggtctcacacggaatgaacgacagcggccaattccaactggatttcaatgacccgcgttacctgccgtttgaaggacttccagttgatgacacagggaccctgacactgagcttcccggatgctgacggcaaacaacaggcgatgctcctcagtctgagcgacatcatcctgcatatccgttacaccattatcagctga

SEQ ID NO: 80 - DNA, 3618 bp, Bacillus thuringiensis
ctatttcattacatatcgaatgtggaatatgacatcatttaagctttctagtaaagagcgctggtcaccatcttttcctgtatggaaaatagctaaagtaagtgtccccgatagcaaattcattccctcgaaaggtagaaaacggctgtcattgaaatctgttatgaataagccactatcatctactccatgagaaagcgtaacagtttcaccgcctagtgataaggttgcttccacatcctgataaggtcctaaaagtgctggtaaggtaactgacagatttttgattttacgattcttttcctttagattataagagttctccaagccaagtgaggataggtcaagacttgcactaaagatattattttgcaacttaacttctattccactcacaccttcaggaattttgccacttagaacttcctgaacaagatctacaaaagcaaactctgggttctttttacggataagagtatctaaggatacagttttcactgcttccataccccatttattttcctctagccatagattttctaatttttgaagttccaccattaacatttccccagcaagtagcccttgatacaaatcatcccaagcagggagagtaaacattcctgttgttttatcctttcctaattctttttctaaagcattctttgccataaaacataaggataatgttgcgtcatacatttgatagtaaagagaagataagcgtccaaccatccaattatataaagcttgactcgaaaaacgagtacattgcaattggtagattgcttgagcatgtgcctgttcagtttccgacaggaaaatttgtttacgggccatgttaatctgttcttgcagagccttaatttgtaaattcaactgcgattcttctgcctcggcagcatctctctgtaacatccaatcctcacgacgtcggcggtaactttcgctgatatccatgatattagctgtctgttccattacattagcactaatttgcaatccctgtgccacagcagtgctagctgctccccatcgggatccccccactgccataccaaacacattaggagccatatctaatgcagcagcaatagtcattgccacttctgagctcgtgtggattattccagcatctgaacgtaattttagtgagctagtttcattatctgacatccagttttccactaaaccagcataatgtgtcttagttgattcggcacttgcttttgctatcgttgtagcttcaagacttgcttgcaacgaatctaggttcttttcctgcatatcacgagtttgctgtagaataacttgctgctgagattgtaataataatgtcatcgcctcggtatcttgttttgcgaatgcattttctaaggcacttccaaattggatcacgctattaactgcagtacgtgctttatcaattacaatagggaaacgatagatactctgtgaactttgagaagaagctacactcccccccatgccatctcctgtactatactgaatctgcaaatcacgcgggttcatcggttcaacaaatagcggtaaattaagaggttgtccatctaaactcagattgtgacgtaagttgtataaacgtagttcgattttatcccagaaagctaacagctcatcattatatggagataaaaaatgtccattttcagatttcagaaatgcttgtaattgcatgattggtgttatgtccaaattatttcttgttggttcagcagtcatagcacctgcttcgctttgcaaggtcggattatcccaactattattaatacgaatttcaggtcggggccccaatatttgtttagcctgtatataatacatcttagcctcagtaagagtatcacgttctaacattctataggcatgatctccgcgattgatgagaaaatctaaagtatgaatgaatatagccagtttgtattgcattgggtcggccatagctatttcatctggatcagtgattgcaagagacaatgtttcatcccactcagtatcttcttgtaacggtactacattccaataacgtacatttccatttttatctttcaacaaattaccattttcgtcacggtagccagcgctgttaaatataaatttgtaccaacgttccaccagttcgtatcgttgttctattagaagcctcacagctattaaaaaaggtatatagaaaaaaatttcccataaataaattccgtaaggtccataaaaagcaatggtgtcccccaactccccctgaactgtatattcaaacaatgtatcaatgctattttcacataagttagctaaatcaatattatttttaagagtaagacttataggttctattattttactatttgatgggggaataaattgatcattgataattgacccatataattcttgataaggacttgggtaatacaaaacactgaaataatactctttttgatcgaaatttaacctcaccagtaacccataataaggttcactatcaaaatctataatataatctttttgttccccctcattaatttctgggtctgaagatagagcgggccaaaaagagagagtagaacctgataattcgctattgtaaatcttttcgaaataaatacgtactctattacctggtaatgaagtcacctttactttaatactgtttggatcatcacagattactttattatcaacaatatggatattttctttagaaaaaccggttattgaattagggatgtaatcaaaacttttgaaaggtgacttctggaaggcagaccacactccagaactattcatgacccaatcatttagatactgtatatcaatagattctttgttaatattttgttttttctctgaagaagaccactgcacatgcaagcgttttttataacagtaaattactacgtagctgtcaactgcttcgccgatattcgcagtgattttttcccactgagtccatttttctggaatcagtatattgttactgttcttttttaggatcaagcttcgccagtaatattcatagggaaatgtttgagttcgaccaacaaagaacaatacactttcagcatcctcaccatcacctttatttacgcttatatattccaaatttgctaaagtttcatattcgtccaaatagttgtgtagtgcatttttgatactttcttcggtaagtctcccttgacttatactctgttctaaatttttgaataagtttgttttattgtaacgtgatgatggatcaatgtagctgcctgcataatattttagacgttctttacctgaccaagtggtatagcgcttgttataattgtcccaattggataagaactttcctggtgcaaaatgacttttactttgcgtggttaactccccttcatagccttgtatacagcgatttatatataactgtacgctactaatagcctctgctatcggagatgttttgacaagatcacttattttagtatctagtaacaaatattcataaagactctccgcatcagtaatcttatctgttagatctttgggaacattgttggcgatataatggtccaccaacacatcacgacgggattctttaatagattgcaatacggttgaattagacat

SEQ ID NO: 81 - DNA, 4464 bp, Yersinia entomophaga
atgcaaaattcacaggaaatggctatcacgaccctttcattgccgaagggcggaggggcaattaatgggatgggcgaatcagtgggtcaagcagggcctgatggaatggtgaccttttccataccattacccttctccgcaggtcgtggcgtagccccggcgctttcgttgagttatagcagcggtgcagggaatggcccttttggtatgggatggcaatgtagtgcgatgagtattagccgtcgtactcaaaaaggggttccccaatataacgaagatgacgagtttcttagcccttccggggaagtgatggctatcgctttaaatgatagtggttttgaagatgtgagaacggctaaccgtctacaaggtatcccattacctttcagctataaggtcactcgttaccagccgcgccttattcaagacttcatcaaaatagaatattggcaacccgttaaacaaactgatggcacgccattctggataatttattctcccgatggacaaacgcatattctggggaaaaattcccatagtcgggtggctaatgctgaaaacccatcgcagattgctagctggctgttggaagaaacggttacgcctaccggcgagcatatttactatcaatatagcggcgagaatcaagtcaattgtactgatgcggaaatagcgcttcatccacaggatagtgcccagcgttatttagcgcggattgactacggtaatatttcccctcaagccagtttatttgttttagatgaagaactacctaatctcacccagtggttattccatttagtgtttgattacggcgagcgagatatctctattaataaaattcctactttcgagggaggaaccaccggttggttagcccggccagatatgtttagccgctacgactttggaattgaaattcgaaatcgccgcttatgccaccaagtattggggttccatcggctggaggccttgaatgatcgagatgtgactgacgaaattcccgttttggtgaatcgactcacgctagattacgacctgaataacagcgtcagcaccttggtagctgtccgtcaggtggcgtatgaaacggacggcagcccaatcactcagccgccgttagaattcgactatcagcgttttgatacagggagtattcccggctggcaggaaatgccgcagcttgaggcttttaacggctatcaaccataccaaatgattgatctgtatggtgaaggtacaccaggcattctgtatcaggaaacgccgggtgcctggtggtacaaatcgccgcaacgccaaattgggggcgattctaatgccgtgacctatggggcaatgaaagcgttgcccaaaatccctcgcttgcaagagggagcgacgctgatggatatcaacggtgacggtcgtttggattgggtgatcacttcagcgggagtacgaggttttcatagtattcattcgacaggtgaatggacacattttacaccattgaacaccttacccaccgagtattttcacccgaaggcacaattagcagatctggttggcgcgggattatctgatttggtgcttatcgggcctaaaagcgtgcggttgtatgccaatcagcaggggaactgggctccggcgcaggatgtcacgcaggcagaaaacgtcagcttaccggtcattggaatcgattcccgtcaattagtcgcttttgccgatatgttaggttcgggtcagcagcatctggtcgagatcacggcagatagcgtgaaatgctggccaaatatgggacacggccgttttggccaacctttgactttggaaggatttagtcagccgcagaccagtttcaaccccgatcgggtgtttctggctgatattgatggttctggcactaacgacattatttatgctcattcggaatgtctagagatctacctaaacgaaagcggtaatcgctttagtaaaccaatctctttattactgccggacggtgtgaattttgataacacctgccaactgcaagcagctgatattcaaggattaggcatcgccagtttggtgatgacggtgccgcatatgtcaccgactcattggcgctgcgatctggcgttgaataagccttggttattgaatgtgatgaataataatcggggggcggaaacctgcttgttttaccgcagttcggctcaattctggctggatgaaaaacagttggttgaggcggcggggcagcaacctgaatgtcatttgccatttcctatgcatttacactggcgtagcgagatttttgatgagattacaggtaaccgtctcactcaagaacaagaatatgcccacggttcctgggatggccaagagcgggaatttcgtggctttggccggttgattcagcgcgatacggatggttttgcccagggaacggtcgacattcctactcatccttcccgaactgttagctggtttgctacgggaatccctgagattgacaccacgctatccgcagagttttggcgcggagatgatcaggcattcagccctttctcacctcggtttactcgttgggaaaacgattcagaggctggttccgatgttgcttttataccttcagagcatgatgccttttggctgaatcgcgcgatgaaagggcaacttttgcgcagcgaactgtatggtgatgatggcactcccgaagccgagattccttattcggtcacagaaatgcgtcatcaggtgcgggcgttgcccacaaccgacgccacagtaccttcggcatggtgttccaccattgaaacccgaagttatcaataccaacgggtggccgctgatcctcaatgtagccaacaagtagtcataaaagcggatcgctatggttcgccattattaagtgtggcaatcaattacccgcgacgtaaaaaaccggaaaagtcgccctatcctgatgatttaccggaaacgctgtttgatagcagctacgacacgcagcagcagcaactgcatctgaccaaacaacagcaaaattattttcatttgaccaatgacgataactggctgttagggctgccaaaagagcaacgaaacgatggctatcagtacgatcaggaacgcgctccggctaacggatttacgctagaaacgctcatcgcgtccaatagcctgatcggttcgaatcagccgtttacctatttgggccaaagtcgggtggcttatcagggcggtgtggatgaacaaccgtctttgcaggcgctggtggcctacggcgaaaccgctattctggacgagaaaaccctacaggcctttgtcggcgtgctggacagcaaaacacgcgatgaattgctgttttccgccggttatcagttggctccgcgcttgtttagggttgagtcagagccggatgtttgggttgcccgtcagggttacagcgaattcggtgactattcgcaattttggcgtcctctcagccagcgtagtacgttgttaacagggaaaactacgttgaagtgggataagcattattgcgtagtgatagaaacccaggatgcggctcaactggtgacacaggcgcgctacgattaccgattccttaccccatatagcctgacggatgccaatgataaccagcactacgtggttttgaatccgtttggggaggtgattgccagccggttttggggaacggaagcgggtaaagacgcgggatacagcactcctcaagccaaaccttttgtggtacctgccacgattgaggcagcactggcgttaagccccggaattccggtggctcactgcgccatttttgaacctgaaagctggatgcaaaaactgacgcagcacgatgtttccgaacgaatggcggataacggtactctttggaacgcattgctgcaggcgcgttttgtcaccgaagatggttatgtctgcgcgctgggtcggcggcgctggatggcgcgccatggtttatcggtgctgatgttgacgctactggccgagattccgcgtacgccgcctcattcccttactattactaccgatcgctacgatagcgatgaccaacaacaattacggcaacgtattctattcagtgatggttttggccgcctgctacaaagcgctcagcgtgttgaagccggtgagagctggcaacgcagcgaagactcctcgctggtggtcaatgtttccggcacaccagccttagtggtgacggataatcgttgggcggtttccggacgtacggaatacgacgggaaagggcaaggaatacgcgtttatcagccttattttctggatgattggcgttatctcagcgatgacagtgcacgcactgacctgtttgccgacacgcatatttacgatcctttagggcgcgaatatcaggtcattaccgcgaaaggttaccggcgtgaacgccagtataccccgtggtttgtggtgaatcaggatgagaacgatacggcagcaaatctggcgatttag

SEQ ID NO: 82 - DNA, 4521 bp, Xenorhabdus bovienii
atgacacaagattcacaggacatgacagtaacacaactgtctctacccaaagggggcggtgcgatcagtggtatgggtgacgccatcagtaatgcagggccggatgggatggcttcgctttctgtgcctttgcctatctctgccggtcgggggagcgcaccgaatttatccctgaactacagtagtggggcaggaaacgggccatttggtattggctggcaatccagtaccatggctatcagccgtcgtactcaacatggcgtaccgcaatatcacggtgaagatacttttttatgtccgatgggagaagtgatggcagttgccgtcaatccgagcgggcaacccgatgtacgtcagaccgataaactattaggcgggcaactgcctgttacttatactgttacgcgtcatcagcccagaaatattcagcatttcagcaaacttgaatactggcaatcgctaacggatgtggaaaccacgcctttttggttaatgtattcacctgatgggcaaattcacattttcggaaaaactgagcaggctcagatcgctaatccggcagagacgtcacagattgcccaatggctattggaagagaccgtaacaccaacgggagaacacatttattaccagtatcgggcagaagacgatatcggttgtgatgacagcgaaaaaaatgcccaccctaatgccagtgctcagcgttatctggctcaggtgaactacggtaatatcacacctgaatccagcctgcttgtgttgaagaatacgccacctgctgatcacgaatggctattccatttggtatttgattatggtgaacgaacgcaggaaataaacacggttcctcctttcaaagcaccttcaaacaactggagaatacgcccagaccgtttctcccgctttgaatatggttttgaagtacgaacccgccgcctgtgccaacaaattctgatgttccatcgcctgaaatctcttacaggagaacagattgacggagaagaaactcctgccttggttgcccgtctgcttctcagttatgacctgaacgacagcgtggcaaccctgactgccattcggcaaatggcgtatgaaacggacgcaaccttaattgctttaccgccactggagtttgactatcagcgctttgaggcaaaagtcacgcaaaaatggcaggaaatgcctcaattggctggattgaatgcccaacagccttaccaactcgtcgatctctatggtgaaggtatttccggcatcctgtatcaggatcggcctggggcatggtggtatcaggcccccatccgtcagaaaagtgttgaagatattaacgcggtaacctatagcccagtaaaacccttacctaagatccccagtcagcaggacagggcaacgttgatggatatcgacggtgatggacatctggattgggttatcactggcgcaggcattcagggacggcacagtatgcagccgaatggcgaatggacacactttattcccatttctgcactgccaacagaatattttcatccacaggcacaactggcggatctggtgggagccgggttatctgatttagcgctgattggtcccagaagtgtgcgtttgtatgccaacgaccggggaaactggaaagcgggtattaatgttatgccacctgatggtgtgaatttgccgacattcggcggtgatgccagcagtctggtcgcattttctgatatgttagggtcgggacagcagcatttggtagaaattgccgctcagagcgttaaatgctggccgaatctaggacatggccgttttggtgaagctattctgctgccggggtttagccaaccgagtggaatattcaatgctaaccaagtttttctggcagatctcgatggctccggcaccgccgatatcatctatgcacacagcaagtatctggaaatttatctgaacgaaagcggcaaccgttttagtgcacccgttcgacttgatttgccgaaaggggtgatgtttgataatacctgccagttacaggtgtcggatattcaaggattgggcgctgccagcattgtactgaccgtacctcatatggcaccgcgccattggcgttatgattttacttacaataaaccttggctgctcaatgtcatcaacaataattctggtgcagaaaccactttgttttatcgtagttccgcccaattctggctggatgaaaaaagtcagatcgaagaatcggggaaatttgcagcgagttatcttccttttcccatacatttgttgtggcgcaatgaggttcttgatgaaattaccggtaatcggctgactaagggcatgagttatgcccacggtgcatgggatggcagagaaagagaattctgcggatttggccgtgtaacgcaaattgataccgacgaatttgccaagggaaccacagagaaaacgccggatgaaaatatctatccttcccgtagcataagctggttttccacgggtctgcccgaagtggattctcaacttccggcagaatactggcgtggtgacgatcaggcatttgccggctttacaccgcgcttcactcgctatgaaaaagcggatgcagggcaagcggggcaggatatcccgattaaagaaccgaccgaaacagaagcgtattggcttaaccgcgccatgaaaggccaattactgcgcagtgaagtctatggtgatgacaaaacagaaaacgctaaaattccgtacaccgtcacagaagcccgttgtcaggtcagattaattcccagcaatgacgaagccgcgccgtcgtcttgggcatcgatcatcgaaaaccgcagttatcactatgagcgtatcgtcgtcgatccgagttgcaaacaacaggtcgtgctcaatgcggatgaatatggctttccgcaggcaaaagtggatatcgcctacccacggcgtaacaaaccgacacagaacccctatccggattcgttaccggatactctgttcgccgatagctatgacgaccagcaaaaacagttatatctgacaaaacagcagcagagctactaccacctgactcatcaggatgattgggtgctgggtctgacggatacccgatacagcgaagtttatcattatgcacaaactgacgctcaaagtgatattcccaaggcagggctgacattggaagacctgctgaaagttgacggcctgataggtaaagacaagacgtttagctatttagggcagcagcgagtagcttacgtgggtggagatgcagaaaaaccgacacgtcaggtgcgggtggcttatacagaaaccgcagcttttgatgacaacgcgctgcatgcctttgatggcgtgatgacttctgctgaactgacgcaacagttgctggcgggtgggtacctgtacgtaccgcaggtttctgatgcggcaggtagtagtggaaaggtatgggtagctcgacagggatataccgagtatggtgatgcttctcagttctaccggccactcacccagcgcaagagcttgctgaccggaaaatatacactcagttgggatactcactattgtgtggtggtaaaaaccgaagatggtgcgggaatgaccacgcaagcgaagtacgattaccgcttcctgcttccggcacaattgacagatatcaatgataatcagcatattgtgacattcaatgcattgggacaggtgacttccagccgtttctggggtacagaaaatggcaaaatgagtggttactctacgccggaaaataaaccgttcacagtgccagataccgtcgaaaaagcctttgctttgcaaccggcgatcccggtttcacagtgcaacatttatgtgccggatagctggatgcggcttctgccccaacagtctctgactggccggctaaaagagggggaaaccttgtggaacgtattatacagggcgggtgtagtgacggaagatggtttgctctgtgaactggcctgccgtcgttggctcaaccgtcagacaacgtcttcaatggcagccgtgacattacagcaaatcttggctcagactccacgacaacctccccatgccatgacgatcacgacagatcgttatgacagtgattctcagcagcaacttcggcagtcaatagcattgagtgatggttttggtcgtgtactgcaaagcgcgcagcgtcatgaagcaggaaaggcatggcagcgtgcagaagatggctctttggttgttgatagtaccggtaaacccgttgttgctgataccacaacgcgctgggcagtatctggtcgcacagaatacgatggtaaagggcagacgatcagagcttacctgccttattatctcaatgattggcgctatgtcagtgatgacagcgcacgggatgatctgtacgccgatacccatttttacgatcctctggggcgtgaatatcaggtaaaaaccgcgaaaggcttttggcgtgaaaacaggtttatgccgtggtttgtagtcaatgaagatgaaaatgacacggcagcacgtttaacatcttag

SEQ ID NO: 83 - DNA, 4458 bp, Photorhabdus luminescens
atgcaggattcaccagaagtatcgattacaacgctgtcacttcccaaaggtggcggtgctatcaatggcatgggagaagcactgaatgctgccggccctgatggaatggcctccctatctctgccattacccctttcgaccggcagagggacggctcctggattatcgctgatttacagcaacagtgcaggtaatgggcctttcggcatcggctggcaatgcggtgttatgtccattagccgacgcacccaacatggcattccacaatacggtaatgacgacacgttcctatccccacaaggcgaggtcatgaatatcgccctgaatgaccaagggcaacctgatatccgtcaagacgttaaaacgctgcaaggcgttaccttgccaatttcctataccgtgacccgctatcaagcccgccagatcctggatttcagtaaaatcgaatactggcaacctgcctccggtcaagaaggacgcgctttctggctgatatcgtcaccggacggccaactacacatcttagggaaaaccgcgcaggcttgtctggcaaatccgcaaaatgaccaacaaatcgcccagtggttgctggaagaaactgtgacgccagccggtgaacatgtcagctatcaatatcgagccgaagatgaagcccattgtgacgacaatgaaaaaaccgctcatcccaatgttaccgcacagcgctatctggtacaggtgaactacggcaacatcaaaccacaagccagcctgttcgtactggataacgcacctcccgcaccggaagagtggctgtttcatctggtctttgaccacggtgagcgcgatacctcacttcataccgtgccaacatgggatgcaggtacagcgcaatggtctgtacgcccggatatcttctctcgctatgaatatggttttgaagtgcgtactcgccgcttatgtcaacaagtgctgatgtttcaccgcaccgcgctcatggccggagaagccagtaccaatgacgccccggaactggttggacgcttaatactggaatatgacaaaaacgccagcgtcaccacgttgattaccatccgtcaattaagccatgaatcggacggcagcccagtcacccagccaccactagaactagcctggcaacggtttgatctggagaaaatgccgacatggcaacgctttgacgcactagataattttaactcgcagcaacgttatcaactggttgatctgcggggagaagggttgccaggtatgctgtatcaagatcgaggcgcttggtggtataaagctccgcaacgtcaggaagacggagacagcaatgccgtcacttacgacaaaatcgccccactgcctaccctacccaatttgcaggataatgcctcattgatggatatcaacggagacggccaactggattgggttgttaccgcctccggtattcgcggataccatagtcagcaacccgatggaaagtggacgcactttacgccaatcaatgccttgcccgtggaatattttcatccaagcatccagttcgctgaccttaccggggcaggcttatctgatttagtgttgatcgggccgaaaagcgtgcgtctatatgccaaccagcgaaacggctggcgtaaaggagaagatgtcccccaatccacaggtatcaccctgcctgtcacagggaccgatgcccgcaaactggtggctttcagtgatatgctcggttccggtcaacaacatctggtggaaatcaaggctaatcgcgtcacctgttggccgaatctagggcatggccgtttcggtcaaccactaactctgtcaggatttagccagcccgaaaatagcttcaatcccgaacggctgtttctggcggatatcgacggctccggcaccaccgaccttatctatgcgcaatccggctctttgctcatttatctcaaccaaagtggtaatcagtttgatgccccgttgacattagcgttgccagaaggcgtacaatttgacaacacttgccaacttcaagtcgccgatattcagggattagggatagccagcttgattctgactgtgccacatatcgcgccacatcactggcgttgtgacctgtcactgaccaaaccctggttgttgaatgtaatgaacaataaccggggcgcacatcacacgctacattatcgtagttccgcgcaattctggttggatgaaaaattacagctcaccaaagcaggcaaatctccggcttgttatctgccgtttccaatgcatttgctatggtataccgaaattcaggatgaaatcagcggcaaccggctcaccagtgaagtcaactacagccacggcgtctgggatggtaaagagcgggaattcagaggatttggctgcatcaaacagacagataccacaacgttttctcacggcaccgcccccgaacaggcggcaccgtcgctgagtattagctggtttgccaccggcatggatgaagtagacagccaattagctacggaatattggcaggcagacacgcaagcttatagcggatttgaaacccgttataccgtctgggatcacaccaaccagacagaccaagcatttacccccaatgagacacaacgtaactggctgacgcgagcgcttaaaggccaactgctacgcactgagctctacggtctggacggaacagataagcaaacagtgccttataccgtcagtgaatcgcgctatcaggtacgctctattcccgtaaataaagaaactgaattatctgcctgggtgactgctattgaaaatcgcagctaccactatgaacgtatcatcactgacccacagttcagccagagtatcaagttgcaacacgatatctttggtcaatcactgcaaagtgtcgatattgcctggccgcgccgcgaaaaaccagcagtgaatccctacccgcctaccctgccggaaacgctatttgacagcagctatgatgatcaacaacaactattacgtctggtgagacaaaaaaatagctggcatcacctgactgatggggaaaactggcgattaggtttaccgaatgcacaacgccgtgatgtttatacttatgaccggagcaaaattccaaccgaagggatttcccttgaaatcttgctgaaagatgatggcctgctagcagatgaaaaagcggccgtttatctgggacaacaacagacgttttacaccgccggtcaagcggaagtcactctagaaaaacccacgttacaagcactggtcgcgttccaagaaaccgccatgatggacgatacctcattacaggcgtatgaaggcgtgattgaagagcaagagttgaataccgcgctgacacaggccggttatcagcaagtcgcgcggttgtttaataccagatcagaaagcccggtatgggcggcacggcaaggttataccgattacggtgacgccgcacagttctggcggcctcaggctcagcgtaactcgttgctgacagggaaaaccacactgacctgggatacccatcattgtgtaataatacagactcaagatgccgctggattaacgacgcaagcccattacgattatcgtttccttacaccggtacaactgacagatattaatgataatcaacatattgtgactctggacgcgctaggtcgcgtaaccaccagccggttctggggcacagaggcaggacaagccgcaggctattccaaccagcccttcacaccaccggactccgtagataaagcgctggcattaaccggcgcactccctgttgcccaatgtttagtctatgccgttgatagctggatgccgtcgttatctttgtctcagctttctcagtcacaagaagaggcagaagcgctatgggcgcaactgcgtgccgctcatatgattaccgaagatgggaaagtgtgtgcgttaagcgggaaacgaggaacaagccatcagaacctgacgattcaacttatttcgctattggcaagtattccccgtttaccgccacatgtactggggatcaccactgatcgctatgatagcgatccgcaacagcagcaccaacagacggtgagctttagtgacggttttggccggttactccagagttcagctcgtcatgagtcaggtgatgcctggcaacgtaaagaggatggcgggctggtcgtggatgcaaatggcgttctggtcagtgcccctacagacacccgatgggccgtttccggtcgcacagaatatgacgacaaaggccaacctgtgcgtacttatcaaccctattttctaaatgactggcgttacgttagtgatgacagcgcacgagatgacctgtttgccgatacccacctttatgatccattgggacgggaatacaaagtcatcactgctaagaaatatttgcgagaaaagctgtacaccccgtggtttattgtcagtgaggatgaaaacgatacagcatcaagaaccccatag

SEQ ID NO: 84 - DNA, 4458 bp, Burkholderia pseudomallei
tcaccgctgctccagcgcctcggtgtcgttttcgtcctccttcaccacgaaccacgggtagtactgcgtccgccgcaagtagcccttggccgtcacaactcggatcagtcggcccattggatcgtaatcctgccgatcggcaaatgcatctgctcgtgcgtggtcgtcccgaacgtagcgccagtcgttcaggaagtacggctgataaacccgcatcacttgccccttgttgtcgtactcgactcggccagtgactgcccaacgaaaatcgctgtacgctgttatcggcacgccggttgcccccgtcaccagcgagccatcctccgccagttgccaagcgtcaccagcttcgtgacgcaccgaactctgcaatacgcggccaaaaccatcgctgaacgtcacctgttgtcgcaactgctgcgccaggtccgtatcgtagcgatcggtcgtcaacgtcaatgtatgcggcgggacacgctgggcctgtgcgagccagctatcgagtgcagtgccttgctgcttccaacgccgtcgagccagcgcgcagacccgattatcctcgctcaccacacctgcgatcctaaggtcgcgccatagcgaggcgtcttcgccatccagctcgcttacctgcgattcggacaaattcggcatccagctatcaggcacgatgacgaagcattccgccaccgggattcccggagtcagcgccaatgcttcatcaacggatgatggagcggtaaacggagcatcctctggagcggagtatcctgcaggcagtccgccttccgtcccccagaagcggcgactgaccaagcgccccaaggcgtcaagcgccccatggtgctgattattgttgctatccgttaccttaaacggcaacaggaagcgccaatcaaaggccgcctgcatggtcaaccccgcggcatcacgagttccggcgactacgcagtagtgcggatcccaggtcaatgtcgtgacacccgtgagcaacgatgcgcgttgacgaagcgggcgccagaattgctgagcgccaccgtaatcggtatagccgcgcctcgccgcccagacggcgttctcagcaccgtccccgagcagtcggggcacacgtaaataaccgcactcaagcagtaatggaccgaggtcttcaggtgcgacgacaccgtcgtacgcaagtagcgccgcatcgtccagcatcgctgtctcggtgaaagcaaccaaagcctgcgaggtgggaaatgcaattggttcctcgctctggcacatcgtgtagtgaacctgttgctgccccgcgaacgcaaagggccgacccgcaccaatcaggctctccgaacccgatagtttttccagtgaaaagccgtccgctggcacacgcgtgctctcgtatgtgaagacatcactgcgctcacagtcgggcagcccgagtcgccacgtttccccgcttgtgaggtgatggtagcgggtcgtccgccgcaccagcgtcacacttgcctgctgagcgtcgtagctattatccaacaacgcatctggcaaagtctccggatacggattgtcaaccggcttcggccgcctcggatacgcaattgctacgctttgcagcggaaagccaaatgcgtccagcgccagctgcacctgctgtgagcactgtggatcgctgccaatgcgctcgtactgatagctgcgaatttccacgaccgatggccacgctgcgggttgttccgtttcggcgctggcgatcagccgaagctggagtcgcgactctgttactgtgtacggaattccttccgatcccgtctcgtccagcccgtacacttcgctgcgcagcagctgtcccttcatcgcgcgactcagccagtagcgggcggactctgacggcgtcaatggttcgtcgtgcccgctggcagtgtcccatatggtaaagcgcggagaaaacccggcaaacgcttgggcgtcaccgtgccagaattcatccgccagccgctcgtcgaccgtcggcatcccggtcgcgaaccagcttcgggtcaatgacggtgcggttcgctgcgagacgtcgccgcacgcgcgcatatcggtatcgaactgctccacgcggccgaatccgcgaaactcgcgctcgttaccatcccaaacaccatgggcaaaacgcatgttcgtcaccagcctgttgccagtgatttcatcgagcagttctttacggcacaatgtatgaataggaaatggtagattcgtcacgggtggcgtatcaacattggcggcagctttttcgtccaaccagaactgtacagagctgcggtagtacaatgttgtgtgcgcgcccatattgttgcaaacgtcactcatcagccaaggcttgtttcgagacaagtcgcaacgccagtggtgcggcgtcgggtgtggaatcgtcaaaacgagactcacaacacccagaccctggatatccgcggcctgcagcaggcaggtatcgtcgaatcgcgccccgtcaggcaacgacaaactttgcggcgcggcaaatccattaccgctctgattcgtgtaaatctgcaaatggtccgagtgcgcatagatcaggtcaacggcaccggatccatcgagatcggcgaggaacacccgccccggatcgaacgtctcagtcggctggttgaatccgggtagtttcagcggcacgccaagacgcccaagtccgagattcggccagcaggtgaccccatcggcgctgatctcaaccagatgcggctggcctgagccgagcacgtcactgaatgccaccaatttgcacgcgtctgcgcccggaatcggcagcgtgatgccatcggattgaatgactgtctggccttgcgtccagccatcgcgctcgttcgcgtaaaggcgcacactcttgggtccgatcaggaccagatctgaaaaaccggcgcccatcaggtctgcaagttgggctcggggatggaaatactcgaccggtaacgcggtcagtggcgtgaaatgcgtccacttcccctcgggcaacactctgtggtagccctgcagccctggatgggttaccagccattccagcctgccgtcgccattgacgtcgatcagtgtggccgtgtccatgccgttcaacacggggatttgtggcaacatgtggctcttgcgccaagtgatcgcgtcgggcgcaccgccctcttggcgctgtggggcacaatagcaccacgcgtggtcatccttgtaaagcacgccggcaagcccgtctccgaagagatcgactagttgccatcgttgcgggagatcgaaattttcgagctcgcgcatcggttgccagatggccgtcggggtgaagcgctgatagtcgatttccagcggcggcatcggtactggacggccgtccaattcgtgtccgagcacccggcaagcaaccagcatgctgaccaccggattctcgtcgtactgcagcaccatacgatgcacgagcgctgggacgtcatctccatttgccacacctgccaacgtctgcaaacggtggaaagcaagaacttgccggcacagccgccgcgtgcggacctcgaaaccgaactcatagcgtgagaatggatcagttcgactcaaccagggctgggacgatgcgaactttggcaccgcgtcgattgaagcggcgcgctcgccatagtcaaacaccaggacgaacagccagcccgcgcttgaaggcgcggtgtcgctcaagacgaacaaacagtcactcggatggatattgccgtaatggacgatcgcgagataacgctgcgccgaggtatctgggtgcgcgtgcttttcggcagcgctgcaaccgacatcgtcctccgcataatattcgtagtagacatgttcgccgcccgccgacatcgattcctccagcaaccattgcgcaacgtgtgttgaattgcccggcgcggatatccttgcttgggcggttttgccaagaatatggacctgcccgtcggcggatctgatcaaccaaaaaccggctccggtgtcgtcggagggctgccagtgctcaatcttgctgaaatttctttcggttcggggttgatagcgagttatcgtatggcgtgtgtccaaaatcacaccctgcaacgcgttggcggagcggacatccggctgcccttctgtgtcgcttgccaccagcaacacctcgccatccggcccaagaaagctatcagtcgaatcgtaacggggcgtaccgtggctcgtccggcgtcgaatcgacatcgtgcccatctgccagccaatgccgaatggcccgttgcctgcaccgctactgtaggtaagccccaacgccggagcatagccacgacccgccgacattggtaatggcagcgacatttccgccatgccgtccggcccgattgcgctcagcgtttgccccataccgcggatcgaaccaccgccgctgggcaggctcaacggaccttgacgaagtcccgatggttcctctggggtacgcat

SEQ ID NO: 85 - DNA, 7254 bp, Burkholderia pseudomallei
ctatggacgctggatctgcttccttttctcctcccagtcgatccggttaaactttccaatagggagtagctgctgaataaaacctatgcgattcttaactgcatccttgtcggtcggttggaaatgtccactttcaaccgaccaggatattaatcgcccggcaccgagctgagggtactccgccatttcgaagttcaggttgccggcaagcaggacaggctttgcactttgtctgaagcgttctgctttgggaatgctccggtcgaacatgttgggcttatcctctttatacgtcagtgacgagtgcccatagtttgctagtctgggaataactttttcggttaaatcctttctctccgctagctctgagtgctcgaagacataaatggatagaggatcctcatatctaatcacatatgataatgttccgtaggggattttttgaactttccctgcggcagtggggaacaaaagataactgtcttcgtcgattctacccaatcgaaatatcatgtcgggtggaagttccaattgcggaaactttttggcctcaatcggcgcagacaaacctcgactcgcctcaagatgactcgccaacacttgaccaatcagcgcttcattttttacctttacattttgaatcaaccctgttgtcggagggaacgaggtatgccgggagtccagctttctggaagcgaccgccacggcagccggactcggagccggcgctaggtccagccagttcagtcgggttgcagctattccgtcccgatcgatgaacgtcaccggattattccttaccatccgatagagattcagtccatcgacggtgccggcggggtcggggttcagccagcgcgccagccagggcgcgtaatggcggtagccgtagtcgtacaggccgctcacgtcgcgctccttgcccgcgtggcgcacgaacttgtagttgccttccacctggcttttgggcagccacaccgcggtgccgccgtacgggtagtattcctcggcgctcaaccgttgcccgctctggtccagttccaggccgctcgagcccaggtgatcattcacgctatagcgccgcatgtcgttgtccaggccgccgggccggctcgcgcgccagtgcaggcagcgcatcgcggtgcggcctgcgaccgcgcttgacaccacctccagcacctcgccggtggccgtgttggtgcgccgctccagccccggcagatagcggacctcgcgccggtgcgtcaccgccccggcctgctggctggaccacttgcgcacccgttggccatcgccgccgtaaccatacgcttcggagtcgtcctcgccaccggtacgcggcagctgcacggcacggctcagtcggttgtcggccgaccaggtgagcggctggttgctgccgagccgatgcgggttgccttgcgcgtcgaactgcgcctcgacgtcgtcagcgccgacccgacggccggccaccgcacggtttgagctccgcgacaccgccagcgccagcacgtaccgggtggccccccggtggacggtgcgcgtcaggttgcccgctgcatcgtacgcgaaggtgcgcgtgtagttgaccagcgcgtccgggttaccgacgggcggcagcgccacgccctcctggccggcattcgcctgttcgcgcccggtggcccgcaccagctggtacagccagtcgtactggtacgtgcgtaccgcggccacccgctggttgcggaagtatctgacccgggtggcctggtccgccagttgggtgacgttgccgacccggtcgtaggtatagcgcaggtcctgcagcaccgtcgcggcacggccggacgcggtccgggtcgtttgggctcgactcaggcgccgggtctgcgggtcgtactcgaagtcgctggtgacgccgttgccggcctgttcatgcagcagctgatggtcggcggtgtaagacagctcgctcaccactgcctgctcggcgccaccgcttaactgcagccaactgcccgaaggccgcccggacacatgccaggcgcagcggtgccggtggccggccgcatcgagcaacatcaactcgtcgcccagcgccgtacactgccaacggctggtttcgatctgctcttcgaggtgggccgcggcggctccgggcgtcgccggccagtcgctggaccagtcgcgttgttgcaagaagcgccgctgctcttcgcggatcatcccgccgaggctgtagctcgtgatctcgcgcaggcctgccggatcgtagtgactgaccagccgtccgcgcaggttcgcacggcgggccgtcacggcatcgatcccggcatcgtcaccgtagcgcagccgctcggtgcagcgttcggtacgactcatcccgctcgcgagccagaccgcgctcagtcggcgcagcgcatcatattcccggcgccattgatgatcgcgagccgtgtagctgcgccacagggcgccgccggcatccagcaggtcgacctgccagccggcgtcgcggctctcgcgggtcacggcagagcccgacagcccatagcggtagcgttcgttgccggcgagtgtcgtctcaccggcctgctgccgatcgaagaagcgcgggtcgctgctcgagacgagccgcccggcggcgtcgtacgcgtggcgggtgatgcggactttgtccgcggtggcggcgccgggcgggggacgttggaccgtgcgcaccgccaggccgcgcccgtcatggaccgtggcgaccggcgcacccatttcatccgtctcgatccggtaccacggccggtactggctcgtgcgccggttgccgtcggccttggtgagttgcgccaaccggcccggcgcgtcgtaatacagcgtgtcgctcgcgctcagctggtccagcttcgggtcggtgagatggaccggccggttcaggtagtacggctggtattgctgacggggcagccccttggcgttgtacaccacgtgaccctgggtcagccagcgctcctcgctgcgctcctgcagcggccggccgctggtatcgagcttgagcttgccgtcgtcctcgacgatcgcactgagtccgccctccgctttgatcttgccctgcagcggccgcccgaacccgtccacataggccagggcgatccggatcacgggatccgttgggcgcggcaccgggtcgtcagcatgctcatcccggtagcgctcggcactcagggtggccgcgtgcaccggcacccgggacactgcggccacggcccgatgcacggcggcgctctgggtgtcgctcagccccggcaccggcgtgccggccttggcgagttgatgcagccgagcctggacatagccttccacggtgatcaggcgctgctggagcaagatttgccagacggcctgaacctcgctgtccggcagccctgccgcgcgcagtccggcctcggtcagcgcgcccatccagctgtgatcagcatggaaataggcctgagcggcgttgccgagggcgccggtcggatcccgtagggccgcttcgaccgtcttgaccgacgagcggtagccggccagcggaccgaagcccactcgagcctcgcccagactgtcggtgaaggcgcgctcgctgcctttcagcgcactcaggtgtacccggccgaacgggtcatagctcacttcatgcaccgtcccattagcgtcggtgatctgggccggcagcaggctccaagggtcgtagtcgatccaggccgcagtgaaccgtgcattgctgagtagggtgggcgcgagggtgagtgcgtcgcgctcgtaggtggtccggttgccgaacgggtcggtgtggtagcgcaccgtatagaaccccgccaagtctgcgaatgtcgcagtcagaccagggttccagaagtagtccttatcatcctcagccgtaccctgcacgaatcccgcttgattgaccagttcgtcttccagttgcgtgagtagcggttccagttgctgtgacggaatcaggccttcaaagctcctccgcaactcggcttggctcaaggcggccgtgcgcacctggcaaacgagcccttcgcgggtggcctgcgccagcgggagcgggtcacccgtcgacggatccgcatagatttgctgttgccagcgggccagggtgcgagtcgcgctcgccagcggaccgtcggccttggtcagctcctcatagctgtagacacggttggcggaagtcggcggggcgacccggccgagcatctcgtcccggttttcgaccggcaggcccagtcgccagccagctcggttcggtttcggttcttgtagatgggtcacgcggatccgggtttccgtgaccaggaacgtgtcctgctgcgcatcgctgcaatgggccgcctcgggcaatggcatgatcggcggcatcacttgcgcacggcgcggatagtgcaggctgacggtcttcgtgaccatgccgtacgtgtccaccgccagcgccacggtctgctgccattgcgggtcggtagacacctgatcatagttgtaatctaggctttccagcacgaacgccagcagcacggcgggcactcccgaggcagtggccggttgccattcccgcacgcagtaccgcaggctcatcacacggaacggcgtggcctggggctggccggtggttggattcagcccgtacacctcctcgcgtcgcacccggccacgcagtgcccgcagaagcacgcgccgctccggcgtgcccggcggcaacgggatggcctgaccgtcccgcctctcgatccgcagcggcgacagggctgccgcgagcgggtcgccgttgtacgaggaaccgcccacgttgccgtccacggcgccaggactgtcagggtcgccggtgtagtaccaggtccgcgtctgcagcgctggaatataaggggtgccggccgcgtcgcgctgcgcggcacccaaggggctgggcatgtccgtgctcaggatcaatccgaagccgcggaactggcgctcctcgccatcgtagtaaccctgccggtattgaagagtctgctccagcgtgttgtgattgatctcgtcgacctgctccagccgcttgagtaccgacaccggaaacggcaggcgacaacgcgcctgcgaatcggcacgacgctcgtcgagccattcgtgtgcggagctggcgtaggtcaggcgcgtctgggctcccatgttgtcgttcagccccgccaacagatagggcttgagcccgcgcgagaagtcgcacacccagtgtgccggctgcggatggagccggctgatgatcagcacgctggtgccgttgccgtacaggtcggccacgctcacctggtgcaggtcggtgtactgcagcgcagccggcaagctcagcgtctgggccctggcgaaacgattgccgcactggttgcggtgcacgtaaagcgtgcggtgatcgagatacagcaggtcggccgcgccgctgccatcgagatcggccagccatacgcgggcgggatcgaagttcgccgcggtaatcgcgggatccaggcgcagtcgcagggtgcgcggcgcgccgaagcggccctggcccagattgggccagcaggtcacctcgttatggcgaacccgcaccaggtgcggctggccgctgccgagcacgtcggcgaaggccgtcagggtctggccgccgcccgggggcaccggcaggcggtccgggccgaggtggtcgatctggcgcggcggagcaaagccgtcgtggccccgattgacgaacaagcgcacactgctgggaccgatcagcgccaggtccgccaggccgtcgccgctcaggtcggcgagcaacgcccggggatggaggaactcactcgggaaggcggcaaacgggatgaagcgctgccagcctttgtcaccgtcgcgcgtaaagaagccggccatgcccggctcggtgcgcacggcatcgaggatgccgtcgccggtgatgtccatcaaggctgcggcgctcatctcgccaccgggtacgctcagtgactgcgccgcctcgtactcgacgtccagcccctggtcaccgcgcttgacatttttggcgcggcggtaccggtagctctggccgtcgttgtacagaatcccgggcacgccctcgccgtagaggtcgaccacctgatagaagcccgcattgagcccaaccagccccgcctcgagcgcacggaagtccgcgcggcccaggtcgaacctcgtgtactccagcgccagcggcggcagcgcggcctgctcgagcgctccgccggtttgccgataaccgtgctggcgcacgccggtcagctgggtcaggtacgcggtttccgtgtggctgagctgcagcgcgcgcaccgccaccggttcggcacccagcgcggcgagctggtgaaacaatacgatgcgctggcacagccgctcgcagcgcagctcgaagccgccatcgaagcgcgagaacgggtcggcgcggcgacgccatggccggctcgcggcccaggccggcccctgcggcgtgtcggcatgttcgccgtagtcgaacaccagcgcgaacagccagcgctcggtggccgggtcgaagccttgcgcggtcgaccacggcgccggatccgcacgcacattgccgaagcgcacctgcttgaggcacgcgagctgcgtgcgagctgcctccgcttcgcggggcgcgtagctgtagtacacatgttcgccgtgcggactcaccgtttcctcaagatgccattcaagcacctgcgccgggttgccggggaccgcggtgcgggcggccgcgcagcggccgaacacctcgcaccggccgtcggcacgccacacccgccaccaggcgggggcgggcgcatcggcgggcgtaagcggctgatgcagctcgaggtagtcgaaccgtccctcgtggcgcatgtggtagcgggtgagacgctcgttgtccacctccgtcggcccggccgcgtccggtaccagttcatcgccctcgaacacgaagacatcgcgtccgtccgcgtagctgggcgtgccgcggctggtctggcgggcaagcgtcggcagcgtcagtgccacccccaacccgaacgggccgttgccctgttggctgtggtacgtcagggcaagcgcgggggcgagccgcaccggcggcagcggcaaggcgatcgacagctgcgcggcgccgctcatcccgctcgggctcagggtttggcccagccccggcagggcgccgccgcccttcgggaacgcggcggtgacgacctgcagcggcggtgtcggcgtggtggtgggcagcgggctcat

SEQ ID NO: 86 - DNA, 4518 bp, Yersinia pseudotuberculosis
ttagggattcggcgtgatttctgacgccgtgtcattttcatcctcgctgataacaaaccacgggaaatagtgtgctcgtcgcagataacctttggcggtgatcacttttatttctcgtccgagtgggtcgtaaatatgggtgtcggcccaggcctctttgcgggcgttgtcatcagcgatataacgccagtcatcgaggaaatagggttgatagcggcggatgggcagacctttattgtcgtactcggtacggccagaaacggcccagcgttgatcgctctcgtcttgcatgagatgaccttgctgatcagctatcagtccgccctctcctgtgtggaaataagcggttcctgcctctacccgttgcgcgctttgcaacacgcggccaaagccgtcgctgaaagcgagagtttgttgatgttgttgtggctcagcagcagaaaagtagttatccacgacgacggttaagacatgggggggttggcgcacgggatttttcaattccaggccgacattttcggtgatgagagggttgctttgtcttatccagcgacgtagagcaagggggcaaagataatagttatcgatcagaatatgattctggaatagatattctagagtgacgttattggtttcagacaatgtttcaatgtcatcaagctgtaacgaaatcatccagctctgaggttgatagacagagaattgcgcgacgggaacttgggtattctccatgctgatagcggcatcaactgaattgggtacggtaaaggggtgctcagcgattaaagggaaaccggttgtgctgacctcaccggtttgtgagtcaagctcggtgccccaaaaacggctggaggtgacgcgccccagcgcatccagttcaatatgacgggagttatcgttgatatccgtgaggtgataaggggtgataaaacgataatcatattcagcctgggtggtactgccatcagccaatatcatttgggtaatggcacagctatttttatcccattctaaggctgtttttcctaccaatggtgagctacgttgactgatggggcggtagaaacgagatgcatcgccatagtcagtaaacccacgttgggcggcccaaatatctgtttctccggggcgagaaaatagacggggtgctcgttgataacctgcctcgataagctgttgtttacgctcattcgttggtaataattcatccaacgcggccaaggtttgatcgtcaaattccgcctgttggctataggcaaccaggcccggaatggtgtccgaggcgtagaaaacctgctgctgcccagcaaaggttcgctctgctttagtaccgagcaggccctctggttgttgtaattcttcccaatgaatccccgctgtaggcacgaaattgtctggataggtcagtacatcactgcgctgcccggccggcaggcctagcacatagaatttatcactgatctcatggcgataagattgctggctttcagtgatgcgcaactgctgctgttgctcgtcaaaatggctgtcccaatgtccttcagccagccaggaatacggaggaatactggctttatcgcggcgtggataatagattgtcgcactgtgcaatgggtgaccaaattcatcgcaacgtagcacaatctgttggttgcattgcgggtcttgcactatgcgttcgtagtgatagttgagttgttccagcatcatcggtaatgctaccggggaggttatttcatccgtagaggattgaatttgccgcacctgatagcgagcactgttgacgctatagggttgtgtggccagttcgctgccgtccagaccatagagttcgctgcgcaacaatgaacctttcagcgccctatgcaaccaataagcttgattatcattgatgtcatttaaggtttcatcaccttgcatttctccggtaaatttcgtcaggcgggtggatagcagcccgtaggcctggctgtcgccctgccaatattcatggtgccaaagttgttcattgccaggctgcccggtatggaaccactggcaggtttgggttggggaggtgcgttcagcggcgctgccttgtgccgaggtattggtatccagcgtatcaacacggccaaaaccacagaattcacgttgtatgccatcataaaaaccatggaaatagcgggcggtttgactcaggctgtttccggtgatctcatcaaattgcgtagtttgcgctaatagatggatcgggaagggtaactggcagaccagtgttcggccctgtttggccgcctgcgctttttcatccaaccagaattggacggaactgcggtaaaacaactgactctctgcacccatattgttattggtggtacacagtaaatagggtttactggcgacaaaatcatagcgccagtgctgtggggccgggtgtggaacactcaggatgatgctggcaacacccagcccttgaatatctgccagtgataattggcagctattatcaaagcgaacacccgcaggcagtgtgacttcaagcggtttggcaaaacggttaccactctggttacggtaaatcagtaattgatgtgcagtggcatagatcaggtcaacggtgccggagccatcaatatccgccagatggatcgccagcggattaaactgctcaataggctggctaaatcccggtaaggagatggggtgaccaaaacgcccgtggccaagattgggccagcaagtcacgctattgtggcgcactcgcaccaaatgctgttggcccgaacccattacatcactgaatgccaccagttcactgtagtgcgctcccgataggggtagcgtgatgtcatcatcttgtgtcacttgggttgcggcagcaaaaccatcacgctggttggcatacaaacggacactttttggcccaatgagggcgagatcagataatccgctaccgatcaagtcggccagttgcgcctgtgggtggaaatactccgctggcagagcagacaacggggtaaattgtgtccagctttggtcggggtcacggctaaagtagcctgccaaccccggttggctaatcacccaatccagcttgccgtcaccattgatatccatcaaggtggcgttttcccccatggctggcagggttggcaacgattgggcaggaccgaaggtgatgccattaagggtgccaggctgacgaaccggtgggcgataacaccaatggcctctgtcctgatatagcatccccggtatcccttcgccgttcagatccaccatttggtactggtggttaaattctgcccaatcctctaatggctgccaattggcggataaatcctgatcatccgattctgtcggattgatttcctctaatcgttgctgccaatagggtttctcgttattgtccgggaatgtctgataatcaaattctaatggtggcaagctgcatgttttaccctttggctcgtgggctaaacgttggcaacccaccagttgcgtggcataaacatcgtgctgatagttcaaccgtaagcggctgaccaatgtcggttgttggtctggttcattaccggccagcgctgacaaattatggtacatcaacacttgctgacacaggcggcgggtacggatttcaaagccatagttaaagtgagagaaggcatcctgacggtaagtccaggatttgccctcttcggctatcggaacctgatcggcgatattactgtattcgccatgatcgaaaatcaggctaaataaccagcttttctccgtgggttgctgagtcagacaatagagttcatgagccacttctctattgccataaaccacggtgcttagatagcgttgcgcactggctgcgggatgattttgtttttcatcctcgtcaataccttgttcatcttctgcctgatacaggtagcagatatgctcgccgctcagagacaccgactcttccagcagccattcagcaatatgctcagggtgctgtggatcggcaattcgggctgaggcggaataccccaaacagtgtttttgaccatctgaaccgtggactacccaaaatggtgcctggctgttatctaccctgggttgccaatactcaatgcgattaaagctgccttcaatacgcggcagataacgaattacgctgaattgctccccttttaatgattgctcagtgcgttcgatatttccctgttgatcaatggcaacgactaatacttcaccactcggtgccagaaattcatcatgttcatcgtagtgaggcactcgcttgctggttcggcggcagatggccatggtgttaagttgccagccaaggccaaacgggccgttgccattgccgctactgtaattgagtgccagtggcggggcataaccgcggcctgcggagataggcaggggtagcgtcagtgttgccatgccactggggccgatagcgcctaaactatcgcccataccggtaatcgcaccgccccctttagggagcgacaagggggcaacggccacttgctgtttactgttttccat

SEQ ID NO: 87 - DNA, 4551 bp, Yersinia pestis
ttgataacgccgttacctcagtcaacaggccccacagagggcctgataggagagccctttatggaaaacagtaaacagcaagtggccgttgctcccttgtcgctccctaaagggggcggtgcgattaccggtatgggcgatagtttaggtcctatcggccccagtggcatggcaacactgacgctgcctctgccgatctccgcaggccgcggttacgccccctcgctcacgctaagttacagtagcggcagtggtaacggcccgtttggccttggctggcaactcggcaccatggcgattcgccgccgaaccaacgcccaagtgccacgttacgatgagtatgatgaatttctggctcccaatggggaagtcatggtggttgccgcggatccgcagggcagtatcgaacgcactgaacagtcactaaatggggaacaattcagcgtaattcgttacttaccacgtattgaaggcaattttcatcgcattgagtattggcgaccccggacaaataacagccaggcaccgttttggttagtccacagttcagatggccaaaaacactgtttggggtattccgctgccgcgcgaattgccgatccactgcaccctgagcatattgctgaatggctactggaagagtcggtgtctctgagcggtgagcatatcggctaccagtatcaggcagaagatgaacaaggcattgatgagcctagtatttataaggctgaaaaacaaaatcatccagcagccagtgcgcaacgctatctgaaacgcgtggtttatggtaatcgccaagcggcgtatgaactctattgtctgactcagcaacctgcgccgacaagctggttatttagcctgatttttgatcacggcgaatacagtaatatcgcggagcaagtgccggtaatcataaaaggaaaatcctggaatttccgtcaggacgccttctcacactttaactatggctttgaagtgcgtacccgccgcttgtgtcagcaagtgttgatgtaccataatttgtcagcacttaaaggtgatgaacccgatgctcaagccacgctggttagccgtctgcgtttacactatcagcacgatgcttatgccacccaactggtcggttgccaacagttagcccatgaacccgatggcaccaaacgtagcctgccaccgctagaatttgattatcaggatttttccactcgcgacgcccttggttggcaaccacttactgattgggctgaatttaactatcagtaccaaatggtggatctgaacggcgaagggatgccggggatgttgtatcaggacagcggtcactggatttatcgcccaccggttcgccaaccaggcaccgccgacggcatcacttttggcgcggcccaacggttaccgagcctacccgcgatgcgcgaaaatgccatgttgatggatatcaatggtgacggcaagctggattgggtgatcagtcaaccgggcttagcgggctactttagccgtgatcctgaccttagccgtgatcctgatcttagctggacccaattcatcccgttatctaccttgccagcggagtatttccatccacaagcgcaactggtcgatttagccggcagcgggttatctgatctggcgttagtcgggccaaaaagtgtccgcgtgtataccaatctgtgtgacagttttgctgccgcaacccaagtagcacaagatgatgacatcacgctaccactacccggagttcacttcactgaactggtggcgttcagcgatgtgatgggttcgggccaacaacatctggtgcgaatacgccacaatagcgtcacctgctggcccaatctcggccatggccgctttggtcaccccctctctttaccgggatttaatcagccagttgagcaatttaatccactagcgatctatctggcagatattgatggctccggtaccattgaccttatttatgccaccaccagccaactgctcatttaccgcaaccagagtggtaaccgctttgccgaaccactggctatcgcgttgccaacaggcattcgctttgataatagctgccaactgtcactggcagatattcaggggctgggcgtggccagcattatgttgagtgtgccgcaccccaccacacaacattggcgctatgattttgtcgccagtaaaccctatttactgtgcaccaccaacaataatatgggcgcagagagtcagttgctttaccgcagttctgtccaattctggttggatgaaaaagcacaggcggccaaacagggccgatcactggcctgccaattgcccttcccgatccatctattagcgcaaaccacgcaatttgatgagataaccggtaacagcctgagccaaaccgcccgctacttccatggtttttatgatggtgtgcaacgtgaattcagtggttttggccgtgtcgatacgctggataccgatacctcggcacaaggcagtgccgctgaacgcactgcgccgaccaaaagcagtcgctggttccacactggccgggcaggcaatgaaacactatggcaaagtgagtattggcagggcgatgaccaagcctactcattgctgcctacccgcctgacaaaatttattaacaatacccaaggtgacgaattactcagtgaactcgatgataatcaaacgttttggttgcaccgggcgctgaaaggttcattgctacgcagcgaactctatggtctggacgacagcgaactggcgacacaaccgtatagcgttaacagctctcgctatcaggtgcggcaaattcaatcctctgctgatggaatctcatccccggtagccttaccgatggtgctggaacaactcagttatcactacgaacgtatcgcgcaagacccgcaatgcagccagcagattgtgctgcgttgcaatgaatatggtcacccactacacagtgtgacaatcaattatccacgccgcgataaagcccgtatttccccgtactcctggctggcaaaggaacattgggatagccattttgacgagcaacagcaacagttgcgcatcactgaaagccagcaatcttatcaccatgagatcagtgataaattctatgtgctgggcctgcctgccgggcagcgcagtgatgtactgacctatcccgacaatttcgtgcctaccgcggggattcattgggaagaattacagcagccagagggcctgcttggtactaaagcagagcgaacctttaccgcgcagcagcaggttttctacacctcggacaccattccgggcctggttgcctacagtcaacaggcagaatttgacgatcaaaccttggtcgcattggatgaattattaccagcgaatgagcgtaaacagcagcttatcaaggccggttatcaaatagcaccccgtctatttgctcgcaccggagaaacggatatttgggtcgcccaaagtgggtttactgactatggtgatgcctcccgcttctatcgccccatcagtcaacgtagtacgcaattagtcgggaaaaccattttggaatgggatgccacctgctgtgctgtcagtgacattatattggccgattacagcatcacccatgctgaatacgattatcgctttatcaccccttatctgctgatagatatcaatgataatcaacattatatcgagctagatgcgctggggcgggttacctccagccgttttgcgggcaccgagattgatccacaaaccaataaagtcattgaaaccggttttccttccatcgcggaacagccctttagcgcccccaattcagttgataaagctctcagcctggagaatacccgcattcccgtcgcgcagttctctgtctatcaacctcagagttggatgatttcattacagcttgatgacattgaaatatggattagagccaataacattactccagaatatctattccaaaatcatattctgatcgataactattatctttgcccccttgcgctacgccgctggggaagacaaaacaaccttctcatcactgaaggtgttggcctgacattgaaaaatcccatgcgccaaccgcctcatatattaaccgtcgtcgtggataactacttttctgcttctgaaccacaacagcatcaacaaactctcgctttcagtgacggctttggccgcgtattactcagcgcacgacgggtggagacaggaccctcttactcattcgatccggaaaacggcctcttagttgatgacaaaggcaatctggtgcaactcgaagtcgatcaacgctgggcggtctctggccgtaccgagtacgacaataaaggtctgccacgccgccgttatcaaccttattttttcgacaactggatctggctttatatcgccaataacagaaccctcaaagaggcttacgccgatacccatatttacgacccactcgggcgagaaataaaagtgatcaccgcgaaaggttatctgcgacgaactcactatttcccgtggtttgttatcagtgaggatgaaaatgacacggcgtcagaaatcacgccgaatccctaa

SEQ ID NO: 88 - DNA, 4287 bp, Serratia entomophila
atgcaaaatcatcaagacatggccattactgcccccacgttgccttccgggggcggtgcggtcaccgggctcaagggtgatatcgcggcggcagggccggatggtgcggcgaccctgagtattcccttgccggttagccccggtcggggttacgcccccactggggcacttaattatcacagccggtcggggaacggcccctttggcattggctggggtatcggcggtgctgctgtccagcgtcgtacgcgcaacggagcacctacctacgatgatactgatgaattcaccggtccggacggtgaggtgctggtgccggcactcacggctgctggcacccaagaagcacggcaggccacctcactactggggataaacccaggcggaagcttcaacgttcaggtttaccgttcacgtacggagggtagtctcagccgccttgagcgttggctgcccgccgacgagacagaaacggaattttgggtgttatatacccctgacggacaggtggctctgctgggccgaaatgcgcaggctcgcatcagcaaccccacagccccaacacagacggcggtttggctgatggagtcctcggtatcacttaccggcgaacagatgtattaccaataccgtgcggaagatgatgacggttgtgacgaggcggagcgcgacgcgcacccgcaggccggcgcccaacgttatccggtggcggtctggtatggtaaccgtcaggcggctcggacgctaccggcgctggtgtcgacaccatcaatggatagctggctgtttatcctggtgtttgattatggtgagcgtagctcggtgctgtctgaagcgccggcctggcaaacaccaggaagtggggagtggctgtgtcgtcaggattgtttttccgggtatgagtttggttttaacctgcggactcgccgcctgtgccgtcaggttttgatgttccattacctaggtgttctggcggggagttcgggagcgaatgatgcgccagcattgatttctcgcctgttgctggactacagggaaagtccttcactcagtctgctcgagaacgtgcaccaggtggcttatgagtcggacgggacgtcttgtgccttgccggcactggcattggggtggcaaacctttaccccgccgacattgtcggcatggcagacgcgtgacgatatgggcaagttgagtttgcttcaaccctatcagcttgtagaccttaacggcgaaggtgtggtgggtatcctgtatcaggacagcggtgcctggtggtaccgtgaaccggtacgccagtcgggggatgatccggatgctgtgacctggggggcggctgcggccctgccgacaatgcccgctttgcataacagcggcatcctggcggatcttaatggggatggtcggctggagtgggtcgttaccgcccccggtgtggcggggatgtatgatcgcacccccggccgcgactggttgcatttcacccccctgtcagccttgcccgtagaatatgcgcatccaaaagcagtgctcgccgatatcctgggggctgggttaacggacatggtgcttatcgggccgcgcagtgttcgcctctattccggcaaaaacgatggttggaataaaggggagaccgtgcagcaaacggaaagactcactctgccggtcccgggggttgacccacgtaccctcgtggcgttcagtgatatggctggcagtggacagcagcatttgacggaggtgcgtgctaatggagtacgttactggccaaacctggggcacggtcgtttcggtcagccggtgaatattcccggttttagccagtcagtgactacgtttaaccctgaccagatattgctggccgataccgacggttccggtaccacggacctgatttatgcgatgagtgaccggttagtcatttatttcaaccagagtggtaattatttcgccgagccgcatacgctgctcttgccgaaaggtgtgcgctatgatcgcacctgcagtctgcaagtggcggatatccaggggctgggggtgcctagcctgttactgacggtcccccatgtcgcgcctcatcactgggtgtgccatttatcggcagacaaaccctggttgttgaatggcatgaacaacaatatgggggcccggcatgcactgcactatcgcagttcggtgcagttctggctggatgagaaagccgaggcactggcggcaggcagttcccctgcctgctacctgccatttacattgcataccctgtggcgttcggtggtgcaggatgagatcaccggtaaccgtctggtcagcgacgtgctttatcgccacggcgtctgggacgggcaggaacgcgagtttcgggggtttggttttgttgagatcagggataccgataccttggcaagccagggtacggcgacggaactgagtatgccttctgtgagccggaactggtatgccaccggggtaccggcagtagacgagcgtctgccggagacgtattggcaaaacgatgccgccgcttttgccgatttcgcgacccgtttcactgtcggttcaggagaggatgagcagacatatactccggacgacagcaagacattctggttgcagcgagccctgaaaggcatcctgctgcgcagtgagttatacggtgccgatggcagcagccaggccgatatcccttacagcgtcactgagtctcgcccgcaggtacggctagttgaagcgaatggagactacccggtggtgtggccgatgggcgcggaaagccgtacgtcagtttatgaacggtaccacaatgatcctcaatgccaacagcaggcggtactcctcagtgatgaatacggtttcccactgcgtcaggtcagtgtcaattatccacgacgccctccgtcggcggacaatccatatccggcgtccttaccggcgacgctgttcgccaacagttatgacgagcagcagcagatattacgcctggggttgcaacagagcagtgcacatcaccttgtttcactgtctgaggggcattggttgttggggttggcggaggcgtcgcgggacgatgtattcacgtactctgcggacaacgtgccggaagggggtctgacgctggaacacctgttggcgcccgaaagcctggtctcggatagtcaggtcggtacgctggcgggtcagcagcaagtctggtatctggattcacaagacgttgccaccgtcgctgctccgccactcccccccaaggtagcttttatcgaaacggccgtgctggatgagggtatggtcagttcactggctgcctacattgtggatgaacatctcgagcaagccggttaccggcaatccggataccttttccctcgaggcagggaagcagaacaggcattgtggacccagtgtcagggatatgttacctatgccggcgcagagcatttctggctaccgctatcctttcgggacagtatgttgaccggcccagttaccgtgacgcgtgacgcgtacgactgcgtcatcacgcagtggcaggatgccgcagggattgtcaccacagccgactatgactggcgcttcctgacgcccgtccgggtgacggaccccaatgataatctgcagtccgtcactctggatgctctgggccgggtgaccaccctgcgattctggggcacggagaatggtattgccaccggttacagtgatgccacgttgtccgttccggacggcgcagcagccgctctggcgttgacggcgcccctaccagtagcacagtgtctggtgtatgtcacggacagttggggagatgacgacaatgagaaaatgcccccgcacgtggtcgtgctggctaccgatcgctatgacagtgataccggacagcaggtccgccaacaggtgacattcagtgacggttttgggcgtgagttgcaatcggcaacccggcaggccgagggcaacgcctggcaacgaggacgcgacggcaaactggtgacggccagtgacggattgccggtcactgtagcaacgaatttccgctgggcggtcaccgggagggcggagtatgacaataaaggtctgcctgttcgggtttatcagccgtattttctggacagttggcaatatgtcagtgatgacagtgcccgccaggacctgtatgccgacacgcacttttacgatccgacggcacgggaatggcaggttattacggcaaaaggtgaacggcgacaggtgctgtataccccgtggtttgtggtcagtgaagacgagaatgataccgttgggctaaacgacgcatcctga

SEQ ID NO: 89 - DNA, 4377 bp, Bacillus thuringiensis
ctattcttccattcctccattattccaagtatcattttcatcttcatttactgtaaaccatggataaaaagcattacgttgctcgtatcctttcgcattcaccactctgatttgtcgtgataaagcatcgtaataatagtttgttgcatacatctgactatgaatagattcattattaacatattgccaatcatgaagataaataggttgaaagtttcgaatcactgtgcctttcccatcataatctgcacgttctgaaataatccatcgcgttttattttcgctcttaattaaattctcttttgcgttatctaagatatctcccttaggttctgctttttgggaactctgtaacatacgtccaaaaccatcactgaagatgattgtagtttgaatttgctgagctggatcatctggataacgatccgcttttaaaattaaagtatgggacggattgcgtattgcacctttgaatatattcgaaacagtttgtgataattgggataaatccttttgaaaacgaccacgagttcgtattcttccgtctaacgtaataaaacgattggctatcaggaaattccacaattctgtaccatctgagacgagttcagaaagttgttcaaatgatattttccccatccaactattcgtatcgtatacataacaagatccaacaggtaaaggtggtaccaaagtaagcgcttggtcaatcgtttcaggtgatgaaaattgtaatgctgggttaaaacctacatcttctcctttttcggttccccagatacggctatatattactcggccgagagcatccaattgaacctgacttacattgttattggcatctataatttgattggcttgcaaaaagcgataatcatatgcaatctgggttttatttttcacagcgtcttcagctgatatcaccacacaccaattatcatcccatgacaatacttgctctccagttaacatagaagcttgttgccctaccattcgataaaagccctctttatttgtataacgagtaaatccttgttctgccactaatacatctggttcgtcttcaaatcctaatatccgtgtactttgtttataaccagctgatgtaagaagcaagtttaattgttcatcactaagtattccttcataagcttgtaaacagacttcatcaagaactgcgcttctcgtgtaataaatcagtgcacgcaaatctggtttgttatcccccacataaatgacctctgtctgtcctccataagcctgttcctgcgcaggagtttgtaaagtaccgtcatcccccagtaactcagtacttatgccttcattcggtacactttcagcaggatagacaaaagcatctaggcggttctgatgaggtattcctagacgccagttctcagaatttgtaaggtgatacgctttttctctttgtcgtgtaaagcgtagtaacatttgttgagaatcatagctgctactccaactagtatctggtagtgtatcaggatacgggttttcatttggctgttcccgacgcgggtagtgaattgtgacactttgtgtcgaagaaccatactcgtcgaagaattgctgtatttgctgcgtacattgtggatcagaagaaatttgctcataattataagtaagctgttccaattgtaatggcaatacaacacattctgaatcagtactctgtaccaaccgtacttgataacggtagctctctactagataaggagacgattctaacatatctcctctaaagatttccgtacgtagtggcattccttttaatgagcgatacagccaatattcttgtcgttcatttagggaatccagtggtacatcctttgtcacatttaaatcaaatgttgtaaatcgacttggtttgagatgaaaagcgataggatctcctttccaagattgagtaaatgtacgagtatcgtcctcttgttgtccggtatgataccaactacgtgttagtatcggttgagtatttttactaatgcttccttcgtagtctctttcttctacctttgtaacaatgtaaccaaatccagcaaattctttttccattcgatcatacacaccattacggtaagtatattcttgtattttcgtactaccgctaatttcatctagtgtttgaatacaagatataacgtttatcggaaacggtaatgtgcaaacaaccgatgaatcagactgtttttcatcaagccaatactgtgcggaacttcgataaaagaattcgttagaagctccaagattgttgctagtacttttcaataaatagggctttatagagcataaatccaaataccaactacgcggggatatgtagggtacatttagtactagattagatatacctcttccgctgatatcagcaggttgcaaccggcataaattatcaaaatgtacaccggcaggaagtggaatctgtaccggatccgcaaagctatttccagaaagattttgataaatgtgcaatgcatcatgagacgcataaatcacgtcagaagtaccagaaccatcaagatccgcaagatatacacgctttggatcaaaatccctttcatttatagtgaatcctggaagtaccaatggttccccaaatattccttgtcccatattcggccagcacgtaacaccatcatgtcgtatacgtactaaatgtgactgtccagaccctaacatatcactaaatgctatcagttctttctcattcaagccttcaattggcaaagtaatacccgctttttgccacacttcacgtgatcgtttgaaacccgattcttcccctgcataaaatcgaacgcttttaggtccaatcataactaaatctggtaaacctgagccagtaacattagaaagctgtgcctttggatggaaaaactctgttggcagagctttgaatggtacaaaattggaccatgttttatctggattcatggtgtagcttcctattactcccgattgtgctatcagccattccaaatatccatcaccattcatatctaataacattccattctggacgttcaccgggatttgaggtaaggacttccagctttcgtatgttataccatctagtgtgtcacttcgaacaggagaacgataatgccaatgacttttgtctcgatacaataaacctggtataccctctccgtacaaatcgacaatttgatattgttcaccattatttaattcaggtgctggtaaaaaaggttgccaatcaataggttgatgaatttcaaatggcgtataatcaaattctagtggtggcatacttagcggttttccgtctgtttcataagccaattgctgaactgcagtcaacatggataccgcgggattttcatcatattcaaattgcatcttccaaattaatgtgggttcctcattcaactctgtaaagttatgaaacattagtacttggcgacataatcggcaggtacgggtttcaaacccatactcataacgagaaaaacagtctgcacgcgctaaccattcaccttgatatgtatattgaggtgaaccgtttactgatgtatcattctctccataatctagcatcacaaaataaagccattggctatccatggggatttccccattccataggtaaagagaatgatatgcaaccttattcccataacgaatggttttaaggtaacggttgcccccatattgatgagtatcctgctttagattaatccctatgttgtcttcttctttgtattggtaataaacatgttccccaaaaggtgatacagactcttcaagtagccattcagctatcttggtaggatcatcaggcgaagctatttttgcttggacagttttcccaaaacaatggagtattccatcagcagaatgaatcaaccaaaatggtgatgtgtgactatcttcttttgcttcccaatattctatcaagttaaagttactttcaattcgtgggaaatagcgagtaacaataaaaggttcacctaatgatattccttgagcagtagtatctgtttgacgagtaataacttgtccattttcgtcactttcgggaactagcacttccccatcaggtccaataaaatggtctccagatttataactaggtatcccagtgtttgttcttcggcgaatggacatgaatcccatgtgccaacccataccaaaaggaccatttccatttccactgctataggaaaggtttacatctggagtaatcgttcgaccaggagtgactggtaatggcacgttaaaacgtgccataccatcggaaccgggagctgtaacgctcccctccattcctttaattgatcctccgccttttggtaatgatggtgaaaataatcctacattggtgttagtctgtgacat

SEQ ID NO: 90 - DNA, 2925 bp, Yersinia entomophaga
atgaaccagtttgattctgcgctccatcagggcacgccgggggttagcgtgctggataatcgtggccacgttatacgggagttacggtattatcgccatccagatacaccgcaggaaattgctgagcgtatagcttttcatcaatatgatagttatgggtttatttctcaaagtatcgatccgcgtctggcggaaagacgaaagcaggatagttcggttaagccgaatttgtcttactttacggcccttagcggcgaagttttgcgtactgacggcgttgatgcaggcacaatcttttccctgaatgatattgccgctcgtcctgccattagcatttccgccaccggcgtgtcacatacctggcaatatgaaggtgaaaatcggccggggcgggtactcagtcgcagtgaaagggagaaagatcgagaagagcgaattattgagcgcttttactgggctggcagtgatgcatcgcaaaaagcgaacaatctggcggggcaatgcttacgccattataacagcgccgggctgaatcaaacgctgagtattgcgctcactggcacgccgatatcggcgtgctttcagccactgctggagagcgcagagccggaatggcaggggacgaatgaatcggcgtggctggaattattgacgccggaaattttcaccacttacaaccgcgccgacgccaatggggaaaccttggtacaaacggacgccatggggaatatccaacggttggcctacgatgtagccggttttcttaaaagcagctggctgagtttaaagggcgggcaagagcagatcatagtcaaatcgttgacctattcggccgccggacaaaagctgcaagaagagcacggtaacggtgtgctcaccacttatagctatgaggcggaaactcagcgtttaatcggtatcagaaccgagcgtccagcggggcatttatcgggagccagagtgtttcaggatctgcgttatacctacgatcccgtaggtaacgtgctgcgtattaccaatgacgcggaagcgactcgtttctggcgtaatcagaaagtggtgccagaaaatacctacatctacgacactttgtaccaattagtcagcgccaacgggcgcgaaatggcaaacattccgcaacagagtagccaacttcccacactgtctccgattgataacaatgcatataccaattacatccgcaattatcactatgattctgctggtaatttgatgcaaattcgccatacatcggccgcagccaataatagttacaccaccaatataactgtttcaaaatacagcaatcgtgcggtattaagctcactaaccgacgatgtcgataaagtggaggcgttctttgacgccgcgggacggcagaaccaactattgcctggtcaaacgttaagctggaatgctcgcggtgaactggcgaaggtcacgccggttgcgcgcgatgggcaggaatctgacagtgaaacataccgttatgatgctaatagtcagcgcgttagcaaaatggctattcagcagtccaataacaatacccaaactcggcgagtgctctatctggcaggtctggaacgaagaacaattcatcaaggtaatacgttgtttgaaacgttactggtggtgaaaattggcgaagctggccgggcgcaggtacaggcaatgcactgggagcttgggcaacctactgaagtggctaacgacgaactgcgttacagttacgataatctgattggcagcagtgggttagaggtggatggaaccgggcaattgatcagtcaggaggaatattacccctatggtggtactgccgtgtggatggcgcgcagtcaacgagaagcgagtgataaagcctatggctattcaggcaaggaacgggacgccacggggttgtattactacggtttccgctactatcagccgtgggctggccgctggctgagtgccgatccggcgggtacgatagatgggctgaatctatttagaatggtcaggaataacccgattgtactccatgatcctgacggcttggctccgggtttttttgagcgcatcagttcatttcggaagaaagacacattaacgatttcatccctcaaaggaaccgggccgttttatacccgttcagaaagcgagattgacatcgattttctgttctccagacaggatagggataaagactttccgccacagaaccacaaggaactttctgcggaagatcgtcgagaggtgttagaagtttcctcaggtgagaatatcacatcagccaataaatcctctaaatggtatgcaggaacacattgggaaactaaaccattaaaaaataatactgatctggtggttcttcacaacggtgtgcagggtgccgcagggattaatattaatctgaatgatataaaacctggccgctccgtgctggtgacggctgggacattaaccggatgtacgatgattaccggtgttaaagggaataatttttatgctttgcatgccggaaccggaaccccatccgaaaattgggtaaccggtgaacacggagtgacggataatttccgaatgctgaataagttaattccggatgccggtattgacctgaatccagaagccgtgaatgacagcttattaacgatattggattattttgataatggaactatcgcttacaacggtaagaaaggcagtgaaatacatagagatgcagataatattctaaattaccgaaccacaggttacgaaaataccgttggtgtatctttcagtctattaacaaaagacaaaaatggtgaggtgtcggcatcaacgttattagagcttggtgagctaaaaccgcataagaaacatagaacaagaggccagtttggaatgactgaactgaaatacgaggccagaaagaataccgtcgttaaattacgctga

SEQ ID NO: 91 - DNA, 2913 bp, Yersinia entomophaga
atggacatacagctgtttagtaaaaccccatcggtcacggtgtttgataaccggggcctaagcgttcgcgatatcgcgtatcgccgtcatcctgatacacctaaagtgacggaggaatgtatcacctatcatcaattcgattttcgcggttttctggctcaaagtttagatccaagactaaatcataaagaggttactaatttttcttatctaactgatttaaatggaaatatcatatatacgcaaagcgttgatgcgggtaacacgctagttctgaacgatactgaaggaagatccgttatagcgatgaccaatattagcagaggggagaatggtaaggacgacctcagtctggccgtcacccgaacctttcagtatgaaaatgccccgttgccaggccgtccactgagtgtaaccgagcaggtgaacggcgaaaacgcgcggattacagagcattttgtgtatgcgggcaatacgccgcaggagaagaatctgaacctcgccgggcagtgcgtcagttattatgatgcggccggcctgatacagacagacagcgtgtcattaacgggtaaaccgttatcggttagccgtaagctgctgaaaaatttggatgatacgaacatcttggccgattggcaggggaacgatacttccgcctggaatagtctgctggcgacagaaatctatactactgtgactcgcacggatgcggcgggtgcggtgctgacaaccattgacgcagtgggcaatcagcaacgcgtggcgttcgatattgcgggccaactgtcagcgagctggctgacgctaaaaggagggcaggagcaggttatcataaaggtgttgacgtactctgccgctggacagaagcttcgagaggaaggcggtaacggtgtggtaaccacttatacttacgaggcggaaactcagcgtttgatcggtattaaaaccgagcgtccgaacggccatgccgccggtgcgaaggtgctacaggatttacgttatgaatacgatccggtaggaaatgttctcagcatcactaatgacgcagaggaaacgcgtttttggcgcaatcaaaaagtggtgcctgaaaatgcctaccgttacgacagcttatatcaattggtcagcgccagcggacgggaagtggcgggagctggccagcaaggcagtgatttaccttcccctctcgttcctcttccctctgattcttcggtatatacgaactatacccgcacttatacctatgattccgccggtaatctaatgcgcatcagacacagtgcgcccgcgaccaataataattacaccctaaacatcaccgtgagtgagcgtagcaaccgtggcgtaatgagttcgctaacggaaaaccctgctgatgtggatgcgctctttaccgcaagtggaagccaaaagtgcctacagcaagggcagagcctgatttggacaccgcgtggtgagttacgcactgtgcttttagtggctcgcggcgaaacggcggatgacagtgaaagctaccgttatgacggcagcagccagcgtattttgaaaatcagttcgcagcaaacgaatcacagtgcgcgggtgcaacgggcgctatatttgccggggttggaatggcgaactatgactggcggcgtggcggaagcggaaaacttacaggttatctgcataggtgaggcggggcgtgctcaggtgcgtgtactacattgggagagcggaaaaccagatggaataatcaacgaccagatacgctggagctacgataacctcacctgtagcagcggtctggaagtggatggcgatgggctggtcatcagtatggaagaatattatccctatggcggaaccgccgtgtgggcagcacggagtcatatagaaacggcatataaaacagtccgatactcaggcaaagaacgggatgcaaccgggctgtattattacggtttccgctactatcaaccttgggcgggtcgttggctctccgccgatcctgcgggtacggttgatgggttaaatctgtatagaatggtgagaaataatccactgcggctcaccgatccggatggaatggctccattagattggctggatttggatacgactaatgcgtctagggatattgttaaggccatttaccaactaaaccagatagacgggcctcatagaggcgttagagatacttatcaacgtatgactgaaagtaccggaatgattttacaggagaccttaaataatgaggcggtgctaaaaggtataaaacagaaagacaaagaaaaaaaatcaagaggaatgaaatttaccaattcaaaattaaaaacctacgccgctcatgcgggtgttttaaatacgctgcaaccggatccggtttataaagatggttttctgaatcttcccggaagcttgggtaataaaaatacctttcccggtgtggaactgattgaggataaagtgaaaccgtcactgagtcagtatcatcctgataaactaggtaaaagtcaaagatggaagccagaatcgagcctggggtattaccgagtcgcagatacagaagcatttatcactggcatccgtagccaatataaatcatcgggaacagatcttcatgcggtggttgaagggcgaattcgggatcatcttttagcaaataataatgttttacctaaaatggccgggatcgccggtttacatgcagaagtacaggcgctgaattatattatttctaatcctgatattgaaggtggaaacgccgaaaggctcaacggcagttatatctttacccaaaggctggttggggatgtgaatcaagatttccccgcctgctataactgttccggaattatatccggtctggaaaacgtcatgaccggacgagtcaacaatgatgtaagactaaagcgtcgaaagtcattttag

SEQ ID NO: 92 - DNA, 2799 bp, Xenorhabdus bovienii
atgactgtaaacagaggcgataacctgcatcaaaaaacgccggaagtgacggttctggataaccgggggttgaccgttcgcgagctccgttatcaccgccacccaaatacccccatcaccaccgatgaacggatcacccgccatcggtttaccctcgccggtcagttggcgcacagcattgacccgcgcctgtttgacttacagcaggcggataatacaatcaatcctaatatggtttatgagacggcactgacaggcgaagtggtgcgcataaggagtgtcgatgcgggtaataccctgatgctgaatgatattaccggccggcctgtgctggccatcaatgcaaccggggtcacccgtacatggcaatatgaagatgatactttacccggacgcccgctcagtatcaccgaacagcctgctgacgaagtagcccgtatcacagagcgttttgtctgggcagggaacagtgaggcggagaagaacagcaacctggccggacagtgtgtgcgtcactatgacactgccggactgaaccagacggacagtattgcgcttaacggaataccgctgtccgtcactcgccgactactgccggacggtacggacgcagactggcagggaaacaatgaatccgcctggaacgaccggctggcaccggaaagcttcaccaccctgagcacggcggatgccaccggtgcggtactgaccaccaccgatgcggccggtaacctgcagcgactggcgtatgacgtggcaggcctgctgactggcagctggctgcggcttgcgggcgggacagagcaggtcatcgtgaagtccctggcgtattccgccgcgggtcagaaactacgcgaagcgcacggcaacggcgtagtgaccacctacacctacgaaccggagacccagcgccttgttggcataaaaaccgaacgcccaccgggacatgcacagggggcgaaggtgttacaggacttgcgttatgagtacgacccggtgggcaacgtggtgaaagtggcgaacgatgcggaggttacccgcttctggcgcaaccagaaagtggtaccggagaacacgtatacttacgatagcctgtaccaactggtttccgctaccgggcgtgaaatggctaatattggccaacagagttctctgttaccccccccttccctcattgatagcagtacctacagcaactattcccgcacctataattatgaccgtggggacaatctgacgcagatacgtcacagtgccccggccaacgacaacagttataccaccaagatgacggtctcagatcgcagcaaccgggcggtgctaagtacgctgacggaaaacccagcggaagtggatgcgctgttcaccacaggtgggcagcagaaccagctgctgccgggacagagcctcgtctggacgccgcgcggtgagctgctgaaagtggcacccgtggtgcgtgacgggcaggtttccgaccaggaatcctatcggtatgatgcggacagtcagcgcatcatcaaaacccacgttcagcagacggctaacagctcgcaaacgcagagcacgttgtatctgtcaggactggagcggcacaccacaacaaatggcacgacggtgaaagaggtgctacacgttatcacgataggagaagcaggccgtgcgcaggtgcgggtactgcactggaagaacggaaaaccggatagcatcagtaacgaccagatacgctacagctacgacaacctcattggtagcagcggcctagaggtggacggagacgggcaaattatcagtatggaagagtactacccgtacggtggcactgcggtgtggacggcgaggaaccagactgaagcgggttataaaactgttcgttactcgggtaaggagcgggatgctacggggctctattattatggctaccggtattatcaaccgtgggcggggcgctggttgagcgcagatccggctgggacggtggacgggctgaatctgttcaggatggtcaggaataatccagtatcagggtatgacaatgtagggcttgtgtggactcctgtaaccaaggctgtaggctccggaatattgggtgcggctacgctggggtacgaagcgtataaacactcaaaatcaaaaaatgaacctgtccaattatcatcaaatacattaggcaataataaaatccatgaatttcacaaggcggtcactgataaaaataataaattctcagtgactgaagaggtaaaagaaaatttatcaggtcgaggaaaggttataaaaaactttcttaccaaaggagaagttcctgctcatgattcaattatgaatcaaaaagagaatttaataacaatagcaaaatacagtcaaaacggggacgtgagtaagttggataaaggcaagttagccattgcctctgtatcagacgcaagtaataatttgccaataagaatttatcaggcttataaaggctttcgtacagccacatcagtgactcctgaaggggtggatgaggtgatggaaagtgtggcaacagcgaaggataacgtaaaaagcaccttgaatgttgggattggcgttggcgtcattggaaattcgctattgtcagtggcaaaagtattcgttcctggagctgctattcctattaccgccggtcaggcactatgggcagtatcatccgtcggaaaaactgtaaaccaggtgaataaagcagtaaaagaaaatattgaaaaatcccctatatctcatgaatttaaagaggaattatttaggcagatgggaaagccaacaaataaagatgggtaa

SEQ ID NO: 93 - DNA, 3132 bp, Photorhabdus luminescens
atgagtccgtctgagactactctttatactcaaaccccaacagtcagcgtgttagataatcgcggtctgtccattcgtgatattggttttcaccgtattgtaatcgggggggatactgacacccgcgtcacccgtcaccagtatgatgcccgtggacacctgaactacagtattgacccacgcttgtatgatgcaaagcaggctgataactcagtaaagcctaattttgtctggcagcatgatctggccggtcatgccctgcggacagagagtgtcgatgctggtcgtactgttgcattgaatgatattgaaggtcgttcggtaatgacaatgaatgcgaccggtgttcgtcagacccgtcgctatgaaggcaacaccttgcccggtcgcttgttatctgtgagcgagcaagttttcaaccaagagagtgctaaagtgacagagcgctttatctgggctgggaatacaacctcggagaaagagtataacctctccggtctgtgtatacgccactacgacacagcgggagtgacccggttgatgagtcagtcactggcgggcgccatgctatcccaatctcaccaattgctggcggaagggcaggaggctaactggagcggtgacgacgaaactgtctggcagggaatgctggcaagtgaggtctatacgacacaaagtaccactaatgccatcggggctttactgacccaaaccgatgcgaaaggcaatattcagcgtctggcttatgacattgccggtcagttaaaagggagttggttgacggtgaaaggccagagtgaacaggtgattgttaagtccctgagctggtcagccgcaggtcataaattgcgtgaagagcacggtaacggcgtggttacggagtacagttatgagccggaaactcaacgtctgataggtatcaccacccggcgtgccgaagggagtcaatcaggagccagagtattgcaggatctacgctataagtatgatccggtggggaatgttatcagtatccataatgatgccgaagctacccgcttttggcgtaatcagaaagtggagccggagaatcgctatgtttatgattctctgtatcagcttatgagtgcgacagggcgtgaaatggctaatatcggtcagcaaagcaaccaacttccctcacccgttatacctgttcctactgacgacagcacttataccaattaccttcgtacctatacttatgaccgtggcggtaatttggttcaaatccgacacagttcacccgcgactcaaaatagttacaccacagatatcaccgtttcaagccgcagtaaccgggcggtattgagtacattaacgacagatccaacccgagtggatgcgctatttgattccggcggtcatcagaagatgttaataccggggcaaaatctggattggaatattcggggtgaattgcaacgagtcacaccggtgagccgtgaaaatagcagtgacagtgaatggtatcgctatagcagtgatggcatgcggctgctaaaagtgagtgaacagcagacgggcaacagtactcaagtacaacgggtgacttatctgccgggattagagctacggacaactggggttgcagataaaacaaccgaagatttgcaggtgattacggtaggtgaagcgggtcgcgcacaggtaagggtattgcactgggaaagtggtaagccgacagatattgacaacaatcaggtgcgctacagctacgataatctgcttggctccagccagcttgaactggatagcgaagggcagattctcagtcaggaagagtattatccgtatggcggtacggcgatatgggcggcgagaaatcagacagaagccagctacaaatttattcgttactccggtaaagagcgggatgccactggattgtattattacggctaccgttattatcaaccttgggtgggtcgatggttgagtgctgatccggcgggaaccgtggatgggctgaatttgtaccgaatggtgaggaataaccccatcacattgactgaccatgacggattagcaccgtctccaaatagaaatcgaaatacattttggtttgcttcatttttgtttcgtaaacctgatgagggaatgtccgcgtcaatgagacggggacaaaaaattggcagagccattgccggcgggattgcgattggcggtcttgcggctaccattgccgctacggctggcgcggctatccccgtcattctgggggttgcggccgtaggcgcggggattggcgcgttgatgggatataacgtcggtagcctgctggaaaaaggcggggcattacttgctcgactcgtacaggggaaatcgacgttagtacagtcggcggctggcgcggctgccggagcgagttcagccgcggcttatggcgcacgggcacaaggtgtcggtgttgcatcagccgccggggcggtaacaggggctgtgggatcatggataaataatgctgatcgggggattggcggcgctattggggccgggagtgcggtaggcaccattgatactatgttagggactgcctctacccttacccatgaagtcggggcagcggcgggtggggcggcgggtgggatgatcaccggtacgcaagggagtactcgggcaggtatccatgccggtattggcacctattatggctcctggattggttttggtttagatgtcgctagtaaccccgccggacatttagcgaattacgcagtgggttatgccgctggtttgggtgctgaaatggctgtcaacagaataatgggtggtggatttttgagtaggctcttaggccgggttgtcagcccatatgccgccggtttagccagacaattagtacatttcagtgtcgccagacctgtctttgagccgatatttagtgttctcggcgggcttgtcggtggtattggaactggcctgcacagagtgatgggaagagagagttggatttccagagcgttaagtgctgccggtagtggtatagatcatgtcgctggcatgattggtaatcagatcagaggcagggtcttgaccacaaccgggatcgctaatgcgatagactatggcaccagtgctgtgggagccgcacgacgagttttttctttgtaa

SEQ ID NO: 94 - DNA, 2859 bp, Burkholderia pseudomallei
ttagtggaaaactttctttgattggctagaacgagtaaagactcgcgcatttccctctcccaaaacctgctgatggtgatacgtcggatctcgaaagaaacccagattcatcacatttccacgataacctactgtcatcagattgcgatagcctttgtctttaagctcattgagcagtgcttgcgcgggagttatgaatttaggtttaacccctgcgccttcttcgcgatcaatttcagaaatgccaaaattacctgattcgcacgaaaaaagtgcgattttcatatttacatcaggtaaatttgctttgcgaaaatttcttgctagttttttaaaagttaacgccttgccgccttcggcggcgccctcaagtcctgcgtagtcagctttgccatgccccaaaacataaagtttatccccgccttgtatattctgaaacacccgatcccgctcctcactctttccttctatgtaaatatttaccagggagtcgtaaagtgaaaccgacaacgatccctctcttattttttccaaatccgtcatctgagtcgaaattttccgcaaatttaatctatcgaagctttctggggtgacgtcatacccaacctcatcaatgtgcctttttccaaaatcaaataattctttaaatttatttgaattaacaatgaatccttccaattttctcataaatctgattctttctttttctgtgagaaagactggcacatctccctgcttggcgaccaatctcctctgagcgttatgcgccgccaacatcataataagatcatcgtcggcaaatgcggggaaaacgtatctcgcatttccttccatatccgtataggtgatcggattattcccgaccatgcagaagaggttgaggccgtcgaccgggccggccggatcggcgcttagccaccgccctacccacggctggtaatatcggaagccgtagtagtacagccccgttgcatcccgctccttgcccgagtagcgaatcgctttgtagtcggcttccatctggctgcgcgcgcaccatatcgatgtgccgccgtacgggtagtactcctcctggctaattaactcgcccgcgtcatccagttccagcatgctgctaccaagctgattgccgtaactgtacctcaccccgtcgttgtccagcccagctggccggcccgtttcccaatgcagcagccgcgcctgcacctgtccagattggctcactgtgagcacctgcagggcctcgcacaaactagcaccattcagcgtgcgatgaacctctagttccggcaggtacaccacccgctgctgccgtgtgctaccgctcgccttgcgttcgttgaccttttgcacgcgcatcccgtcgcccccatagctgtaccactcgcggtcatccccgccctcgcgtgaaaccggcacgacttgttccaattcgccccggccgttccaggtcaacgcttgccccggcagcagcaccagctggtggccgcccgcgtcgaagcacgtatccacggcttccggcagtagcccttcctgcgccaacactgcgcggttgctgcgcctagacacggtgatgtccgtcgtatagctgttgttggttgccgggtcgctgtgccggatctgcaccaaattgcccgcgtggtcatagcgataggtccggcggtagttactgtagacgccgagatgggccggtaagggcgtcacgggcctgggcagcgcgctgccctgctggccccgctgagccagttcgcgcccactagcctcgatgagttggtacagcgagtcatagcgataggtattctccggctccacgcgctggttgcgccagaacagcacaggctgcgcttcattgcgctcgctcagcacattgcccaccgggtcatatgtatagcgtagatccagcagcacccgggcgccagccgcatgcccgctcgcacgagcgctccgcatcccgaccaaccgctgcgtttcaggttcgtagcgatattccgtgatcactccattgccgtgcacttcgcacaacttttgccccgccgccgagtagctcaggctcgcgagaatcacccgctcctcctgccccgccaactgcacccaagcccccttgatctgtccggccacatcgtacccccagcgctgtacattgccccgcgcatcgatgtgcgtgattcgcatcgcggtagcgtccaccgtgctgcagctcccatagcgcatgttctccagcgccggcagccaaaccgactcgtcctcgcccgaccagtttacttcccatgcatcgcgcagtagccggcgcgacagcgtaagcgtggcgccgtgcagcgagcagcgctgcagctcgataaccccggctgtgtcatagtggcgaatgcactgacccgccagattctcgtcctgttcgggcgcgcttgtgccggcccaatggtagcgctcgatgacacgcgtcaccgcccccggggcctgctcactcaccgcaagcaaccgccccggcaggtctggcgcctcgtactggtagcggcgaatcatgccggtggccgacatcatgtacaccgggcgcccctcgatatccagcagcagcgcgctgcacccggcatccacgctctcagcgcgcagcaccgcgccggacaggtcgtggtacttgatgaagttcggcactggtaaaggagccatttcccccaaccgcgggtcgtagctgtgtcgcagcctgcctagaacatcatagtactggcgtgtgatccgcagatccggcgcctcgccggccaccgcccggtgacacgcgatgcgtcgcaccactagcgcacgcgcatccataaccgtcatgctcggcgtgcctgcatgcaggctcatgtcaggtgtggaaaacat

SEQ ID NO: 95 - DNA, 2985 bp, Yersinia pseudotuberculosis
atgagaacatcattgttcagtaaaaccccttcggtcacggttcttgataaccgcggcctgaccgtgcgcgacatcgcgtaccaccgccatcccgactcgccggatgttaccagtgagcgtatcacccaccatcagtacgacgcccgcggctttctgacacagagcgccgacccgcgcctgcatggtgccgggctgatgaacttcagctacctgactgacctgaccggccgcatcctgcgcacgcagggggcggataacggtaccaccgtcagcctgaatgatgctaccggacgaccatttatctcggccagtaatatcagcaccagcgacgacggtactgaagacagaggccaggcgatgacccgcacctggcagtatgaggaggcttcactgccgggacgtctggtgagcgtaaccgaacaggtgaccggcaaagccacccgcatcacggagcgcttcgtgtacgctgccaatactgacgcggaaaaaagcctgaacctggccggcgcgtgcgtcagccattacgacactgcgggactggtgcagccggacagcattgccctgaccggtgtaccgctctctgtcacccgccgcctgatgaaaagtgcggataacccggacgccgtggccgactggcagggggcggacgcctccgcctggaacgaccaactggacggcgaaacgcataccaccttgaccaccgcggacgccaccggggcggtgctgaccaccaccgatgcgaaaggtaacctgcagcgcatggcgtacgacgtggcgggcctgctgtcgggcagttggctgaccctgaaggatggcacagagcaggtcatcgtgaagtccctgacatactcagccgccgggcagaagctgcgcgaggagcacggcaacggcgtggtgaccacgtacgaatacgagccggaaacgcagcgcctggtcgggattaaaacggaacgtcccgccgggcacgcctccggggcgaaggtgctgcaggacctgcgttacgagtacgacccggtgggcaacgtgctgaaggtcactaacgatgcggaagagacgcgcttctggcgcaatcagaaagtggtgcctgagaacacgtacacctacgacagcctgtaccagttggtcagcgccaccgggcgcgagatggcaaacgccggccagcagagctgcagcttaccgtccaccaccgtcccccttcctgccgacagctccgcgtatacccgctactcccgaacctatacctacgacgaagccggcaacctgacgcaaattaggcacaatgccccggccaccaacaacagctacaccacaaaaatcaccgtcagcgaccgcagcaaccggggtgtactaagcacactgaccgaaaatgccgcagacgtggacgcgctgttcacggcaggcgggcagcagactcagttacagccgggacagcatcttatctggacggcacgtaatgagctgctgaaggtgacgccagtggtccgcgacggcagcacggacgacagcgaaagctaccgctatgatgcagccagccagcgaatcctgaaggtcagcaggcagaaaacgaacaccagcatgcagacacagcgggtactgtacctgccagggctggagctgaggagtaaaaaatccggcgatacggaaacggaaggcctgcaagttatcacagtgggtgaggcgggccgtgcgcaggtgcgggtgctgcactgggagagcggcaggccggatgaaatcactgacgaccagatacgttacagttacgacaatctggccggtagctgcagcctggaactgggcggtgacggcaatatcatcagcgcggaggagtattatccgtacggcggcacggcggtctgggcggtgcggcgcgcggtggaagcggattacaaaaccgtccgctactctggtaaggaacgggatgcgacggggttgtactactacgggtaccggtactatcagccgtgggcgggcagatggctctccgcagacccggctggcatggtggacgggctgaatctgttcaggatggcgcgcaataatcctgttgcgtttattgatcgtaatggtcttaattcagaattgttatattctcaggcattcaagcggacggcaaataaatataacgtaattattggtgtaagggcacctaatccattaggtgaaactttattaaaagaaggctttccatcaaaaaatttccatatgaaggcaaaatccagtccaacaggaccaaccgcaggttttattgcagaagacccgatttactctaaggtgtcaccttctgcatataaaaaacagagagcatcaattgataaggcaaaagctttgggctcggaatctatagatttattcattagcaaatcacgaattaatgagttaatagatactgggaatttaaattctctaggcgaaaatcgttactcagcgaagtatccgtatggtactcaagagtttgagattggaaataatggaagagttttaaattcagagggaaaacctgttaaagtaatgactaatccaccggagattggagagagaaaaagcaatagttcccccataacagccgattacgatttgtttgcaattataccaagtgttaatcagtcagttaatgaaagacccctgacagtgccccataagttgttacgtggtgatttttctctccccttcaccagtccaaaagggaaaaatggcatgagtgaagatgtaaatatgggaaatcttcatcattttgggaaaacgatcgtcaacagtttaaataaagagattaacgcagagggatatgctggcggtaaattggtctggcataacgatgaagctggaaatccatttagccctggatttgatgagaatgacaaaccaattttcttcctcccatcaggaggtatgttccaggcaaaaaataaaagtgaattgcttggtttttattccagattgcggaggagtggatacactccagagcatagtccaatttttggtttttaa

SEQ ID NO: 96 - DNA, 2625 bp, Yersinia pestis
tcaggggtctttcattaactgactgattaacacttggataattgcaaacaaatcgtaatcggctgttatgggggaactattgctttttctctctccaatctccggtggattagtcattactttaacaggttttccctctgaatttaaaactcttccattatttccaatctcaaactcttgagtaccatacggatacttcgctgagtaacgattttcgcctagagaatttaaattcccagtatctattaactcattaattcgtgatttgctaatgaataaatctatagattccgagcccaaagcttttgccttatcaattgatgctctctgttttttatatgcagaaggtgacaccttagagtaaatcgggtcttctgcaataaaacctgcggttggtcctgttggactggattttgccttcatatggaaattttttgatggaaagccttcttttaataaagtttcacctaatggattaggtgcccttacaccaataattacgttatatttatttgccgtccgtttgaatgcctgagaatataacaattctgaattaagaccattacgatcaataaacgcaacaggattattgcgcgccatcctgaacagattcagcccgtccaccatgcccgccgggtctgcggagagccatctgcccgcccacggctgatagtaccggtacccgtagtagtacaaccccgtcgcatcccgttccttaccagagtagcggacggttttgtaatccgcttccaccgcgcgtcgcaccgcccagaccgccgtgccgccgtacggataatactcctccgcgctgatgatattgccgtcaccgcccagttccaggctgcagctaccggccagattgtcgtaactgtaacgtatctggtcgtcagtgatttcatccggcctgccgctctcccagtgcagcacccgcacctgcgcacggcccgcctcacccactgtgataacctgcaggccttccgtttccgtatcgccggattttttactcctcagctccagccccggcaggtacagcacccgctgtgtctgcatgctggtgttcgttttctgcctgctgaccttcaggattcgctggctggctgcatcatagcggtagctttcgctgtcgtccgtgctgccgtcgcggaccactggcgtcaccttcagcagctcattacgtgccgtccagataagatgctgtcccggctgtaacttagtctgctgcccgcctgccgtgaacagcgcgtccacgtctgcggcattttcggtcagtgtgcttagtacaccccggttgctgcggtcgctgacggtgatttttgtggtgtagctgttgttggtggctggggcattgtgcctaatttgcgtcaggttgccggcttcgtcgtaggtataggttcgggagtagcgggtatacgcggagctgtcggcaggaagggggacggtggtggacggtaagctgcagctctgctggccggcgtttgccatctcgcgcccggtggcgctgaccaactggtacaggctgtcgtaggtgtacgtgttctcaggcaccactttctgattgcgccagaagcgcgtctcttccgcatcgttagtgaccttcagcacgttgcccaccgggtcgtactcgtaacgcaggtcctgcagcaccttcgccccggaggcgtgcccggcgggacgttccgttttaatcccgaccaggcgctgcgtttccggctcgtattcgtacgtggtcaccacgccgttgccgtgctcctcgcgcagcttctgcccggcggctgagtatgtcagggacttcacgatgacctgctctgtgccatccttcagggtcagccaactgcccgacagcaggcccgccacgtcgtacgccatgcgctgcaggttacctttcgcatcggtggtggtcagcaccgccccggtggcgtccgcggtggtcaaggaggtatgcgtttcgccgtccagttggtcgttccaggcggaggcgtccgccccctgccagtcggccacggcgtccgggttatccgcacttttcatcaggcggcgagtgacagagagcggtacaccggtcagggcaatgctgtccggctgcaccagtcccgcagtgtcgtaatggctgacgcacgcgccggccaggttcaggcttttttccgcgtcagtattggcagcgtacacgaagcgctccgtgatgcgggtggctttgccggtcacctgttcggttacgctcaccagacgtcccggcagtgaagcctcctcatactgccaggtgcgggtcatcgcctggcctctgtcttcagtaccgtcgtcgctggtgctgatattactggccgagataaatggtcgtccggcagcatcattcaggctgacggtggtaccgttatccgccccctgcgtgcgcaggatgcggccggtcaggtccgtcaggtagctgaagttcatcagcccggcaccatgcaggcgcgggtcggcgctctgtgtcagaaagccgcgggcgtcgtactgatggtgggtgatacgctcactgataacatccggcgagtcgggatggcggtggtacgcgatgtcgcgcacggtcaggccgcggttatcaagaaccgtgaccgaaggggttttactgaacaatgatgttctcat

SEQ ID NO: 97 - DNA, 2922 bp, Serratia entomophila
atgagcacatccttgttcagtagcaccccgtcggtcgcggtgctcgacaaccgcggcctgttggtgcgggagctgcagtactaccgccatccggatacaccggaggagacggacgagcgtatcacctgccatcagcacgatgagcgcggcagcttgtcacaaagcgccgacccgcggttacacgcggccggtctgacaaatttcacgtacctgaatagcctgaccgggacagtactgcagagcgtcagcgccgatgccggtacgtcgctggaactgagcgatgccgccgggcgggcgtttctggccgtcaccggggctgggacggaagacgcggtcacccgcacctggcaatatgaagacgataccctgccgggccgcccgctgagcatcaccgagcaggttaccggtgaagccgcccaaattacggaacgcttcgtgtacgctggcaatacggatgccgagaagattctcaatctggctggccagtgtgtcagtcattacgataccgccggactggtgcagacggacagcatcgccctgagcggcgtgccgctcgccgtcacgcggcagttgctgcccgacgcggcgggggccaactggatgggtgaggatgcctcggcctggaatgacctgctggatggggagacgttcttcacccagacccacgctgatgcgaccggcgccgtcctgagcatcaccgatgcaaaaggtaatctgcagcgtgtggcatatgatgtggctgggctgctatcgggcagttggttgacgctgaaggacggcacggagcaggtcatcgtggcctccctgacgtactcggccgccgggaaaaagttgcgtgaagaacacggcaacggcgtggtaacctcgtatatttacgagccggaaacacagcgcctgacggggattaaaacggaacgtccgtctgggcacgttgccggagcaaaagtgctgcaggacctgcgctatacgtatgacccggtaggcaacgtactcagcgtcaataacgatgcggaagagacccgcttctggcgtaaccagaaagtggtaccggagaatacgtacatctacgacagcctgtaccagctggtcagcgccacagggcgtgagatggccaatgccggccagcagggcaacgacttaccatccgctacagccccccttcctacagacagctctgcctacaccaattacacgcgcacctaccgttatgaccgtggtggcaacctgacgcagatgcgccacagtgcccctgccacgaacaataattatacgacagacatcacggttagtgaccgcagcaatagggcggtactgagcacgttggcggaagtgccgtcagatgttgatatgctgttcagtgcaggaggtcaccagaagcacctgcagccggggcaagcactggtgtggacgccacgtggagaactgcaaaaggtgacaccggtggtgcgtgatgggggggcggacgacagcgaaagctatcggtatgatgcgggcagtcagcgtattatcaaaaccggcacgcggcaaactggcaacaacgttcagacacagcgggtagtgtacctgccggggctggagttacgtatcatggcaaatggcgtgacggaaaaagaaagcctgcaggttattacggtgggcgaggctgggcgggcacaagtgcgcgtattgcactgggagatcggcaagccggatgacctcgatgaggactcggtgcgttacagttacgataacctggtgggcagcagccagctggagctggacagagagggttaccttatcagtgaggaggagttctacccgtatggcggaacggctgttctgacggcgcgaagtgaggttgaggctgactacaaaactatccgatactcaggcaaggagcgtgacgcgacggggctggattattacggttatcggtattaccagccatgggcagggcgctggctctccacggacccggcaggcacggtggacgggctgaacctgttccgcatggtgcggaataatcccgtcacgctgtttgacagcaacgggcggatcagtactggtcaggaggccagacgattagtgggggaagcatttgttcatccgttacacatgcctgtttttgaaagaatttctgtagagagaaagatttcaatgagcgtaagggaagctggcatttatactatttcagcgctgggtgaaggtgcagcagcaaaaggccataatattctagagaaaaccattaaacccggttccctgaaggctatctatggtgataaagctgagtcaattcttggactggcaaaacgtagcggtctcgttggccgagtaggacagtgggatgcatcaggtgtacgtggaatttatgcgcacaacagaccgggtggtgaggatttggtttatcctgtcagcctgcagaatacttctgccaatgaaattgttaatgcatggataaaatttaaaatcatcacgccctacaccggggattatgacatgcacgatattattaaattctctgatgggaaagggcatgtgcctacagcggaaagtagtgaggaaagaggagtaaaagatctaattaataaaggtgttgcggaggtcgatccttccagaccctttgagtatacagcgatgaatgttattcgccatggaccacaggtgaactttgttccctatatgtgggaacatgagcacgataaagtcgttaatgataatggttatctgggggtggtagctagcccggggccgttcccggtagcgatggtacatcagggggaatggactgtttttgacaacagtgaagaactgtttaatttctataaatctacaaatacacctcttcctgaacactggtcccaagattttatggacagagggaaaggaatagtcgcaactcctcggcatgctgaacttcttgataaacgacgagtcatgtactaa

SEQ ID NO: 98 - DNA, 2766 bp, Bacillus thuringiensis
tcatcgaatacacttggagaaaacacccgcaaaactatttttttgcacagttttttgtattgctctatttttgggactatactgttcccataaatcaggactatcattccatggagtcgtctctagtttctctccgtttctatagaaaactacacgcccctgtaatctctcacggtttcgataaacatagcgtaactcggaagctgtaattgattcaccagaatcacctctcttagcaactatgctttcaatatctaaattatcgagtacaaaatgtatttttgttttctgatttgaagcagcaatcgctatgcctaatttactacctcgtttccatagtagctttgggaccctatccgccccgccgcccgtgtaatatttatgataagtatcagtattaattttatctttagtctctttatagatagcccctatattaaattttaagttctccattcctctagtaaaataatcgtcccacaaaggatatcttcctctcttatctgtagaaatgatatcttttaaatcctttggtactttgggatgttccgcaattttcataccttttatgtttttattcaatatatgctttgagacttcattgttatattgatctataatcataggttcgctttctgccgaatctgaaacaaaagtttttcctctaagggctgcttctatatatcgccctctctcgttagcaaggccataaaataaatcaccattttctttactataattcgttatttgtattggtgcatttccatcaggatctattagatttatggggttattcctcaccatacgatataaatttaatccatctactgtaccagcaggatcagggtttaaccaccttccagcccatggtatatagtatctgtgtccataataatacaaacctgtagcatctcgttcctttccggaatagcgaatagtcttataatttgcctcaatttctgtacgagctgtccataaggctgtaccgccatatggataaaattcttccttacttatgattttcccttgcttatctaactctaatgaagatgaacctagatgatccgtgacgctgtatcgatattgattatttgttataccagtaggttgcgtttcatctttccaatgtaatacccttacttgtgctgctgtaactatttgcaggacttctgtaacattatcaccaatttgacgtgtacgcagttctagtcccggcaaataaattgtcgtatcagttttagttatatcttgtttctttcgagtatcctgttttacgattctcattcctgaactattatagagataaccttcccaatcgttttctttatcttcacgtaccaccatattgacacggcttaattgatttcgtgcatcccattccataggtattcctggaagtaaaattttttgattacctgctctatcgaaataattctcaaaatttgatacattattttctaggctcaaaagccctctatttgaagcaacatcgacatcaatattggtagtatattgagttgctccagtatgactaagttttatcaaatttccagcacgatcataactatatttttcagaataatttacatactggttatcatctagtggaataggcgttatcacggatgggaaggattggtactggcgaagcgtatcagattccctccctgaactagaaataagccgatacagtgtatcatatgtatattgccgttttggtacaattatttggttacggaaaaagcaaaccgaatccatttcattactaatagacaagatattccctacagggtcatattcataatgataatcttgcagtatttctcttcttttagagggtatcttgcgtgaatctttttttctcattaagcgttgtgagctttcttcatatgtatattctgttacgataccatttcctgcctcagttcttagcacttgccctgcagcattgtattctatcccatttacaatactttgttctatctgaccccacagtttaatatgaatgtttttgggttgaccaatagaattataagtaaatgtttgaagattacctttggcatctatttgagataatttttttccttgtacgtcatattgccagcttgtatcataggtttctgtatcaagaaaatttatccaagcactttcaccatcagcgctccagttgctaggttcatcaatattctttaacaattgccgactttgataaagtggtaatccagataaagaaaagctttttgtttgattacgacctgcgatatcgtaatgacacaccaactgaccacataaattgttggcttgggcacccctttcgttctcaccgtaaaaaaaacgctccctatatttaggggtttcattgccatccagtttttccaacacagctgttggtcttcctactaaatcgtattccatagttgtttgtgtacgatttgcatccctaaaccaaattggtcgtccctctatattaaagatttgtaccttttgtccagcatccacactttcagtacatagtatattcccttttaaagaatgatcgtatctcatatttggtagtgtattatcgttattttgatattgtgaaaatagacgaggatccatactatcatcaagatttcctaacaatgtataagtgtttcgagtgacatattcatctatggggtcctcaactgtaacacgattatattcaagggtacgaatctgtaagcccctattatctataacagaaatcgtaggtgtcccattatatatagaatttgtatccaa

SEQ ID NO: 99 - DNA, 2784 bp, Bacillus thuringiensis
ttaggcaaccatttgtccgctgctatttggcacccagtactttttaatgttagatatcgtcttaattttaagaccttccataattttatcttccgggaattctagtgttagtagacctagtacactatcttggtttattacgctcgctatccctcccaagaggtctcctaagacttctggtcctaccagagtatatgcacagtccgtacaagtaataaacggccttatttctgcaggttttgtttttccttgattcactctattaacatataatataaggtcttctggatttgtatccttgtaatctgtcttccccttatctaaaagtgcgctgttgattgcataaacttctgcatgcgaacctgctccttttgtccagtctttatataatttactaacaccttttgacatttgatcaggaaccctctctgctattctagaatcctttttttctggtaatttgccatctacgtgattaaatccaacatgatatttttttgaatttaaattatatgcaactgcaactgccggacctaaattattttttgaatatttatccttatactctctttcataatgtatagctatctttacaagattagtttctatatcatcaaaattctctctaatatcattccattttgcatcagtattacccatttttattgaagaaagatttattttcatgttagaaagatccgtttttgttttaatttcagtaacttcttgagaggataaagtaaagatatttggtttttctgggagcaatcccattttatctattgaatttatagggttattcccgaccattcgatataagttcattccatctactgtaccggcaggatccggattcaaccagcgccccaaccatggcatataatacctgtatccgtaataatagagacctgtagcatccagttcctttcctgaataacgtatggtcttataatttgcctctactttcgtccgcgctgtccacacggctgttccaccataaggataaaattcttctttacttatgatttgaccttgtatatccaactccaacatcgatgatcccaaatgatcgttaatactgtatcgatattgatcattagaaacctcattcggctgggttccatcctcccaatgtagaactcttacttgtgctatttccgtatctacagtaactacatgtaggagctctgtgaatttttcacccgtttgacgtgtacgtaattccaaaccaggtaaatagacagtagtatcagtttgagtggtattctttgtctttcggttattccattttactatgcgtattcctgtgctatcgtagatatagctctcccaatcattatcttcattttcacgtaaaaccatattgacacaacttaattgattacgtgaatcccagtccagtggtatcccagtccgtaaaactttttgattgcctgctctatcaaaagaagatgaaatatctggtatttcatctttttgcctccagactcccttgtttgaagtatcatcaatataaatatccgttgtatattgactcgctcctttatggttaagttttatcaaatttccagcgcgatcgtaatgatatttctcaaaataatttacgtatttactatcatctagtggaataggtgttattaatgaagagaaagattgatgctgacgaagagcatcagattcccttccagaattagaaacaagttgatataaagcatcatatgtgtattgacgttttggtaagacggcctgattgcggaaaaagcgaaccaaatcagagtcattactaatagacaggatattacctactgggtcatattcataacgataatcctgcagtacttctatcttctcagaagatagctcacgtgaatctttttttctcattaagcgctgcgtactttcttcatatgtatattctgtcaatataccattaccagcttcagttctttgcacttgcccagcagcattgtattctatcctgtttgcaatgctctgttccgattggtcttgtaatgtaagattaacagcttttggttggcccaaaatattgtaagtaactgtctgcagattacccttggcatctatttgagcgacttttctcccttgtacatcatattgccagttggtactataggtttcagcatcaagcaggttagtccaagtattttcatcatctataatccagttgctagattgattcatattttttaacaattgccgagactgattaagtggcattcctgtcaatgagaagttttctgtttgtatccgacctgcggtatcataatgacgtacaagttgaccacgcaaattgttagctagggcatttctttcatcttccccataaataaaccgatctttacattgaggtatttcctcgtcttcttgcttttcaaatacagctatgggtcgtcctaccaaatcataatcgctacttgtctctatattattggggtccataaaccagatggattttccttctgcattaaataggtttaccttccgaccagcatccacactttcagtacggagttcctctcctcttagagaaggaaagctatttatattcggtgatgtactgttatcatcttgatattgtgaaaacaagcgaggatctatgctactttcaagatttcctaataatgtataagtgtttcgggtgatatactcatctactaaatctcttttttcaagacgattatatcttaggtcacgaatctgtaaatttctgttatctacaaccgaaatcgtaggagtaccgctatagatagatggtgtattcat

SEQ ID NO: 100 - DNA, 2037 bp, Yersinia entomophaga
atgaaccagtttgattctgcgctccatcagggcacgccgggggttagcgtgctggataatcgtggccacgttatacgggagttacggtattatcgccatccagatacaccgcaggaaattgctgagcgtatagcttttcatcaatatgatagttatgggtttatttctcaaagtatcgatccgcgtctggcggaaagacgaaagcaggatagttcggttaagccgaatttgtcttactttacggcccttagcggcgaagttttgcgtactgacggcgttgatgcaggcacaatcttttccctgaatgatattgccgctcgtcctgccattagcatttccgccaccggcgtgtcacatacctggcaatatgaaggtgaaaatcggccggggcgggtactcagtcgcagtgaaagggagaaagatcgagaagagcgaattattgagcgcttttactgggctggcagtgatgcatcgcaaaaagcgaacaatctggcggggcaatgcttacgccattataacagcgccgggctgaatcaaacgctgagtattgcgctcactggcacgccgatatcggcgtgctttcagccactgctggagagcgcagagccggaatggcaggggacgaatgaatcggcgtggctggaattattgacgccggaaattttcaccacttacaaccgcgccgacgccaatggggaaaccttggtacaaacggacgccatggggaatatccaacggttggcctacgatgtagccggttttcttaaaagcagctggctgagtttaaagggcgggcaagagcagatcatagtcaaatcgttgacctattcggccgccggacaaaagctgcaagaagagcacggtaacggtgtgctcaccacttatagctatgaggcggaaactcagcgtttaatcggtatcagaaccgagcgtccagcggggcatttatcgggagccagagtgtttcaggatctgcgttatacctacgatcccgtaggtaacgtgctgcgtattaccaatgacgcggaagcgactcgtttctggcgtaatcagaaagtggtgccagaaaatacctacatctacgacactttgtaccaattagtcagcgccaacgggcgcgaaatggcaaacattccgcaacagagtagccaacttcccacactgtctccgattgataacaatgcatataccaattacatccgcaattatcactatgattctgctggtaatttgatgcaaattcgccatacatcggccgcagccaataatagttacaccaccaatataactgtttcaaaatacagcaatcgtgcggtattaagctcactaaccgacgatgtcgataaagtggaggcgttctttgacgccgcgggacggcagaaccaactattgcctggtcaaacgttaagctggaatgctcgcggtgaactggcgaaggtcacgccggttgcgcgcgatgggcaggaatctgacagtgaaacataccgttatgatgctaatagtcagcgcgttagcaaaatggctattcagcagtccaataacaatacccaaactcggcgagtgctctatctggcaggtctggaacgaagaacaattcatcaaggtaatacgttgtttgaaacgttactggtggtgaaaattggcgaagctggccgggcgcaggtacaggcaatgcactgggagcttgggcaacctactgaagtggctaacgacgaactgcgttacagttacgataatctgattggcagcagtgggttagaggtggatggaaccgggcaattgatcagtcaggaggaatattacccctatggtggtactgccgtgtggatggcgcgcagtcaacgagaagcgagtgataaagcctatggctattcaggcaaggaacgggacgccacggggttgtattactacggtttccgctactatcagccgtgggctggccgctggctgagtgccgatccggcgggtacgatagatgggctgaatctatttagaatggtcaggaataacccgattgtactccatgatcctgacggc

SEQ ID NO: 101 - DNA, 2067 bp, Yersinia entomophaga
atggacatacagctgtttagtaaaaccccatcggtcacggtgtttgataaccggggcctaagcgttcgcgatatcgcgtatcgccgtcatcctgatacacctaaagtgacggaggaatgtatcacctatcatcaattcgattttcgcggttttctggctcaaagtttagatccaagactaaatcataaagaggttactaatttttcttatctaactgatttaaatggaaatatcatatatacgcaaagcgttgatgcgggtaacacgctagttctgaacgatactgaaggaagatccgttatagcgatgaccaatattagcagaggggagaatggtaaggacgacctcagtctggccgtcacccgaacctttcagtatgaaaatgccccgttgccaggccgtccactgagtgtaaccgagcaggtgaacggcgaaaacgcgcggattacagagcattttgtgtatgcgggcaatacgccgcaggagaagaatctgaacctcgccgggcagtgcgtcagttattatgatgcggccggcctgatacagacagacagcgtgtcattaacgggtaaaccgttatcggttagccgtaagctgctgaaaaatttggatgatacgaacatcttggccgattggcaggggaacgatacttccgcctggaatagtctgctggcgacagaaatctatactactgtgactcgcacggatgcggcgggtgcggtgctgacaaccattgacgcagtgggcaatcagcaacgcgtggcgttcgatattgcgggccaactgtcagcgagctggctgacgctaaaaggagggcaggagcaggttatcataaaggtgttgacgtactctgccgctggacagaagcttcgagaggaaggcggtaacggtgtggtaaccacttatacttacgaggcggaaactcagcgtttgatcggtattaaaaccgagcgtccgaacggccatgccgccggtgcgaaggtgctacaggatttacgttatgaatacgatccggtaggaaatgttctcagcatcactaatgacgcagaggaaacgcgtttttggcgcaatcaaaaagtggtgcctgaaaatgcctaccgttacgacagcttatatcaattggtcagcgccagcggacgggaagtggcgggagctggccagcaaggcagtgatttaccttcccctctcgttcctcttccctctgattcttcggtatatacgaactatacccgcacttatacctatgattccgccggtaatctaatgcgcatcagacacagtgcgcccgcgaccaataataattacaccctaaacatcaccgtgagtgagcgtagcaaccgtggcgtaatgagttcgctaacggaaaaccctgctgatgtggatgcgctctttaccgcaagtggaagccaaaagtgcctacagcaagggcagagcctgatttggacaccgcgtggtgagttacgcactgtgcttttagtggctcgcggcgaaacggcggatgacagtgaaagctaccgttatgacggcagcagccagcgtattttgaaaatcagttcgcagcaaacgaatcacagtgcgcgggtgcaacgggcgctatatttgccggggttggaatggcgaactatgactggcggcgtggcggaagcggaaaacttacaggttatctgcataggtgaggcggggcgtgctcaggtgcgtgtactacattgggagagcggaaaaccagatggaataatcaacgaccagatacgctggagctacgataacctcacctgtagcagcggtctggaagtggatggcgatgggctggtcatcagtatggaagaatattatccctatggcggaaccgccgtgtgggcagcacggagtcatatagaaacggcatataaaacagtccgatactcaggcaaagaacgggatgcaaccgggctgtattattacggtttccgctactatcaaccttgggcgggtcgttggctctccgccgatcctgcgggtacggttgatgggttaaatctgtatagaatggtgagaaataatccactgcggctcaccgatccggatgga

SEQ ID NO: 102 - DNA, 4716 bp, Acidovorax avenae
atggccacgttcgtcaacgaccgcagagcgatccacgaaggccgcagcccggcgatgatcccgggcccggtgaaccccgtgtttcccaagcccaacgggccgcccgtgccgatcctgaacatggcgcacgggccgggcctcaagaatggcaccgccaccctgaagatcgacggccagcccgtcgccattgccggcagccgcttcgaatccatccccgccacgcccgaccgcctgggcggcatcgcgggcgtcaggtccaccgtggtgggcggcgcggccgagcccaccagctacagcagcgacaccaagttcgagagccgcggcagcgtgcgctcgttcgacaccaccaagagcaattcgctggtgatcgacccgggctggcgtgggcgcctcgcgatggcgctgctgccggagccctacgacaagctggccctgaaagtcatcgaaaagctccccggcgctttcgaggccgagttcgccgccctgggcgagagcctgaccgaccccagtgcgcttatcggcccggccctcaaggtgatcggcaagctcatccccgggttgaatgtgctgatgaatggcgccgcgatggcccaggcggcaggccagatcgacgcgttggcgcagaaggtgcaggaattgctgactccgccgatgaccgacgccaagctcgacgagatcgcgcagatcatcgccgacgaggtggcgatgatcacgacgcaattcgtggtcggcaagatcgccaagcgcgctcgctcgcgtcccggcccggtggccaccgggcatgacaaccgcaccaatcccaacacgacggccagcatcatggacgatgcccgcaagggcttcgcgccgaatgccggatgcgaactgggcacctgccaccccgtcatcttcgccacaggtgcgaagatcctcgccgacaccgacttcgagctgcccggcccgctgccgctcgcatggcgccgcttctaccgatccagcgaccggcgcccgggatggctcggctggggctggagcacgccgctgtccatcgaactggcgctgacctacgacgccgtgcattactacgacgcgcgcggccgcctcgtgcggctgcccgtgctgccgcgcggcgccagccacttcgatgcgcgcgagaagatcaccgtacggcaccacgagggcggcggctggagcatcgaagccaccgacggcctgcgccatgaattcccggcccccgtgcccggccagtggcgcctgccgctggcgcgcatggccgaccgcaacggcaacgccgtcacgctgcactaccccgcgtacgacgccaccggcgccgacggctgcgcgccgcggcccctgggcctgacggacagcgccggccggcaactgcgcttcgaatggagtggcgaagagggcgcgccggaccggctgctgcaggccatccacctggagccgcgcacgctcgatggcgtgcagcacgcgggcggcgtgctcgcgcgctacgcctatggcaccgagggcaacgaggccggcgacctgcgcgccaacctggccgaggccgccgatgccctgggcggcaccgcgcgctaccgctaccgccaccacctgatggtggcctatgccacccgcaacggcttcacccaccaccagcaatggagccgccacgatgcaggcgggcgcgtcgtgcgcacctggacggacacgcccggcctgctggacacgcgcttcgagtacgacctgggccggcgcactacccacgtgaccgacgcgctgggccggcgcagcagctacgaatacaacgcggcgcacgaagtcgtcgccatcaccgaacccggccccgacggccgccccgtgcgcaccgagacgcggctggacgccgccggcaaccccgaggaggcccgcgacgcgctgggccgggccacgcgctggcgcttcgatacgcgcggcaacctgctgaccgtgaccgacgcggccggcgccaccacgcgcctcgcctacggccacctcgacctgccggtggagatcaccgatgcgctgggccatgtctggcgccagcaatacgacgagcgcggcaaccttgccgagcgcgtcgatccgctgggccatgccacgcgctggcgccacgacgcgcgcggcctgcccgtggccatcgaggacgcgcacggcaagacccgccgcctgctgtgggacgacgccggccagctcatcgcctacaccgactgctccggccagaccacgcgctacacctgggacacgctcggcaacctgctcacggccaccgacgccctgggccagaccacccggtaccgccacgacgccctgggccggctgcgccacgtggtggcgcccgacggctcggagcaccgctacgactacgacgcgcagggcaacctcaccgcctacaccgacccgcagggtgccgccacgcgctatgcctataacgggctggaccagcccgtgctgcgccaggacgcactcggcggcacgctgcgctaccagcacgacgccgtgggccgcctcgtggcgctgcagaacgagaacgacgacaccacccgcttcacctacgacgcggcggacaacctgatcgaggaaatcggcttcgacggccgcatccagcgctaccgctacaacgccgcgggcgagctggccgaactgcacgagcgcgacgcgcggctgcccccggacacgccgtacgaccccgaccccgccgcgccgttaccgaagcgcaccgtgttccgccgcgacgcggtgggccgcctcgtcgccaaggcccacgtggggcccgatggcgtggaggagggggccggcagccgcgatgtcaccaccttcgcctacgacctgctgggccgcatgctgcaggccggcaacgccgatgcgcgcgtgcatttcgcctacgacccgctctcgcgcctcgtcgaggaagtccaggagcacctggcaccggacggggccggcaccctgggccgctacgcctggcgccatgcctacgacgcgctgggcaaccgcacggacagccgcatgcccggcggccggcacgtgcaatggctctactacggctcgggccacctgcaccagatccgcgtggacgggcatgtgctctcggacatcgagcgcgacgcgctgcaccaggagatcgagcgcacgcagggcgcgctggaaagtcgctacggctgggacccgatgggccggctggtggcgcacaaggtgggccggcggcaggcgctgcagggccagccgggcatgccgtcaccacaggccctgcgggaccgggaccagggcctgcccgcattgccgcagcttccttcgggcgaccgcatcgcgcggcagtaccgctacgaccccaccggcaacctgatcgccacgcgcgacgggctgcgcggcgacagccactaccgctacgacccgctgggccgcatcctggcggcgcagcgcggtgacggcaaacagcaggccaccgagcgcgaaaccttcgcgttcgacccggccggcaacctgctcaaccccaaccggggcgcggggccgcaggcgagcggcggcgtgggccagcgtgatgttgtgccgcacaaccgcctggcggtctaccaggacctgcgcttcgcctacgacctgcacggcaacgtcaccgagcggcgcatcggctggcacacggtgcagcactaccgctacagcccggagcaccagatcgtggaggcgcgcgtcgtgcgctaccgcgaccgccccgccgaagcgcaagggcatgcggagcctgcggccacggagcaggtcacccactaccgctacgacgcgctgggccggcgcatcgagaagcgggacgcgttcgggcgcacggccttcctctacgacggggacctgctggcgggcgaactgcgcggcagcaggctgtcggaatacctctacgagccggacagcttcgtgccgctggccaagctggagtcggagtggaagggcgaggccgcagagaaagagggggcacgacccaaggatttcgccgcctactactaccaatgcgaccagatcggcgcgccgcaggagctgacggacgagcagggccgcatcgtgtgggcagcgagctaccgggtgtgggggcagacgcaggcgctgcaggtgatgcgcacgggtacggacgacgcggcggtgttcacccaggcggagcggcctttggcgctggcggctaagggggacgtacaggcgctgagcttcgtgcagcagccgctgcggttccaggggcagtacttcgatggcgagacagggctgcactacaaccggcatcggtactacgatccagtgacggggcgattcgtgcaccaggatccaattgggctggaaggtagtgagaatttttatgaatatgcacccaatccgttggaatgggtggatccggcggggctcaataaaaagcgtaagcgttgcggttgtcaattgccgtgcattgttatcgacagctcaaagtatcctgagacggctcaacatgtgaaagaagcaatcgctgcagggcatcccgatgaactaacaattgatcgtccggggtctaaagcccgtcgtcgggcatcccttaagggagttaaaacaaaacctacgaaagatagggatgagtatcctcccgctatgttcaaagaaggcggcaaaggtgcagatgtcaaattgattgattcctgtgataatagaggggctggctcttgtatggggcatcaatgtgctccatatcccaatggaacaaaggtaaagataaaggtcaagtaa

SEQ ID NO: 103 - DNA, 4815 bp, Acidovorax citrulli
atgcccaaggccgcccgactgcacgatccgatcgcccatacctatgcacgcgaagggcatgcggcgggggccgccacagcggtcgcgctcgagttcggcacggccgtcgctatcggggccgcggtcggatcaatcgcgtgcccgggtctcggcacgctcgcgggcatcgccatcggcatcggcgttgcgctggtttcgttcgccatcgcgcacgtcgcgagtctttatggtgatttcgcgcaatcctttggcgaggccttcgggcgaagtttcacttctgattgtggcgagctcaaggcgaccggatcgagcacggtcttcatcaacggcaagccagcgattcgcacgggcctggatgtggccgagtgcgacaagcacaagatgccgcccagtctggtgatctacggcagcgagaacgtcttcatcgacagctaccgcgccgctcgcgaaggcgaccgtgtggactgcgaggccaaaatcagcaagggctcggaggatgtcttcatcggtggcgagtccgtgcccatcgcggagttccgcgtgaacgaagtaccggagtccgaccgcgagttcgccagaaaggcccgcttttgggcaggcattctcggcggcggcgtcagcgcactgaaggctggcgtcaagtgtttcgggatggccgtgctcaccggcgtggtgggtgcgaaggtgatgggagagatcatgccgtcgttcgatggcgggcactccgcggcaacggccttgggcgacgggatgggcacggccgtcggcaatctcctgcaaggcaagccggtacacgtggtgaccggcgccaaggtgctgctgggtgacgacgacaccgacttcagcctgcccggggcactgcccatcgtctggcgccgcacttatgcgtcctgcgatgcgcgcacgggcgcgctgggcactggctggagcctgcctttcagcgtggaactggtcttcgagggcggcaaggcgcacttcatcgatgaggccggccgcgacatccccttcgacgacctgccgcccggcggccagatgttcagcgtgccggaaggcgtgcaactgagccgcggggagggcggcgcctacttcatcggcatgcctgcgctgggctggatctactgcttcggccagcgcgccggcagcagcgatggcgaacgcctcgggttgcagcaatgggcggatttcaacggcaacaccatcgacttccatcgcgatgccgatggcgtggtgcggcatgtgaccgacagcgcaggccaccggctcgcgctgcgctatgcgcaggccggcgggctgcgcctcgtgcgcgtggacctcacggcgggcggcccggccggcacgctggtcgaataccgctacgacacccgcggccagcttgcccaggtcatcgaccgcctgggccgctgcgtgcggcgcttcacctgggagggggccaccctcgtcgcgcaaaccttcgcgagcgggctggtggcccgctaccggtgggacgggcccgcgccccaaggccgcgtggtgcagcactggctggaggatgcggccccgggcatgcccgccaccgcctggaccttcgaatacgacctgcccggcgaacggcccggcgatcggcgcacgcgcgtcacggaccacctcggaagggtgcaactcttcgaccacgatgcggaccagaacgtcacgcgcatcgaggatccgctggggcaggtgcagcgcatggagtggaacgacctgtggcaactgctggcctggacgcgcgcggacggcagccggttcaccttcacctatgaccgcctgggcaacctgaacggcgccaccgacccgttggggcagaccgcccggctggactggcacgaacgcctgcagcgcgtgcgcgcggccaccgccgtggacggaacccgctggcactacacctatgacgaccgcggcaaccgcacggaagtgctggggccgccgctgaagcctggtacgccgccgcatattccaagtgatggggacgaggttcgctggcgtgaatccacgctgcacgatccccgtggcctgccggtggtcaccatcgacgcgaacggtggacgccagcaatggacctgggatgaacgcgccctgctggtgcgccacaccgactgctcgggcaagaccacgcgcttcgagtacgacggcaatgggttcttgagcaagcacatcgatgcgctggggcagatcacccactacgtgcatgatgcgttgggacgcctgttgagcgtgacgcgggcggacggaacagcggaacgatacacctacgacggcgcagaccagctagtttcggcgggcgattcgagcaaccggctcacgcactaccgctatgacatccacggcaagctgctggcactgcaacgccccgacggcagcacggtccacctgggctatgacgcagcgcaccgcctcgcaagcctcgtcagcgagaacggtgccaactaccgctttgcctacgacaccgccaaccggctggtccaggaacagcggccggacggtagccgtcacaccttctctcacgattcgctgggacgagtggtggaactgcgggaagaccccggcgaggacgacgtcgttgggcaggcaatccgggggcatgcgccggcagcgccgatccgcaccacctgcgagcgtgacggcatcgggcggctgatcgcgaagcgcgtgcaggccatgacgggggcaccgtcttcgcaagacaccatcgagcagcgcttcgcctacgacaagatgaaccggctggtgcgcgcggagacgctcgatgctgcgggacagtcgcccgcgcaagtggcggaattcggctacaccctgctgggggatctggcgcaggaagcagcggaggacgttgtatccggcacccgcagcgtgatgcgccacacctgcgacccgttgggcaatcgccttgccaccgaactaccggatgggcgcttgctgcgcgaattgcattacggcagcggccatgtccaccagatcagtttggacggcgtggtggtggccgacatcgagcgcgacgatctgcaccgcgaggtgctgcgcacgcagggtcgctgggcgagccgctgggcctacgacccgctgggccggcaacgggcacagtggacccaatcagcgagcctgcgtgtcgggggcaactgggcacaacagatgccggacgcggcgaacgcgtctggaccgggcatgctaacggatggcctgcgcaagcaatgggactatgacgctgcgggtgagctggtgcgcacgcgccacagccgaaatggggagacccagtaccgctatgaccccgctggccatgtcctatcggctacgctgcaggctgccggggccgcaggcggtctttctccggcgttgcaacaggcgctgcacgaagtgtttcattacgatcccgccggcaatcggctggacgcgcccgtgcctcaaggcgcagaaggtagccggggctgggtgcgccacaaccgagtgaaggtgctgcaggacaagcgcttcgactacgacggcttcggccggctggtgcgcaagcgcatcggcgggcacaccgaactgcactgccgttacgacgcgctacaccgcatgatcgccgcgtcggtgatccgtgcgggccgcgacggagagccgatccggcaggtcttccgctaccgttacgacccgctcggccggcgcatcgccaaggaggacgacttcggcgagacgcgattcgtatgggagggcatgcggcttctgcaggagagccgcggcgcgcacaacagcacctacctgtacgagccgtccagctaccggccgctggcgcgtatcgacggtaccggtccgctggagccggagcatccagttgcagtgctggcgctcgcaggggaagacccgcgaggcgacccggccgcgggcaaggtccgttcgattccggtcaccaatggtgacgccagtgatgcgcgccatgctgtggctggacccgtgggggcgaccgcacgctatctggctgaggtggaagccctcgagcgcggcgctgggccagatgagcccggccagtccacagggcggggcgggcaggcacggcagacccagagtgcatccactccttccgcgcggatttactacttccacctacaacccagcgggttgcccgaggagatgagcgatcgcaatgggcacctcgtgtggcgggctcaataccgcttgtggggcaatgcggtcgctgaggagtggcaggccttcgatgcaacgggccgaccggtgaacgctccgatggcggagacgggcatccgggcgcaagtcagcgcgtcacccgctccccaaaacctgcgtatgcaggggcagtacctggaccgggaaacggggttgcattacaacaccttccggtactacgacccggaccttggtgccttcaccacgccggatccaatcggtttggctggcggtctgaacctgcatgggtatgcagcaaaccccctgtcctggatcgatccctggggctgggcctgcatcccgaacaaggtggcaggcaccgcacgcgaagcgcgcgtaggtgctaaattggacggtaagttcggcgcgtcaaatgtcttgcgtgaacgatatcttcgcgatgcaaacgggaagattgttcgcgaccctttgacgggggaagcgcggcgtgtcgactttgtcgtaaagggttccgatggcaagggcacagcgattgaggtcacgagtaaaaccgctaataaggatgcgcagcagctgaaggaggcgcgaattagagcccaaggcggagtttatgtgcgtgagccaggatcaaaggtgctggttgaagtgcgcaatacatctagagttgtaagagtggagtga

SEQ ID NO: 104 - DNA, 6678 bp, Bacillus cereus
atggaaggtaagaaacaaaggaagtggtatcagtatttaatacaacttatcgtagttgcattaattgttacttctataccactgaatgggttggcagaaacggcaccaccgtttacaccatctccaaattcagaacaaagtccagaagtggaaaagaaagaggagcaggaattaccagctccacatccggatcaattaaagaaggataaggctaaagcacaggcgagtccgactgagattgtagaagaaagaacggaaaccgaaaaggtttttgataacaatgatggtacttttacaaagagggtatatacggaaccgattcatgcagagaaagatggaaagctagaagaggtttcgccaaaattagtagaagcaccaaatgaaaaaattgtaacggaaaatacaacattagaaccagagttcgagaaagcgacacaagatggaaagtacgttcaatttaaagtaaaagatcatactattcagtataaactaataagtgcaaatggtgaaaaaggtgaaataaagccatcgccagtaaccgcaacacatgaaaataatacagtatggtataaaggggtcttcccaaatattgatttaaagagtacgacattcaatgaaaatgtaaaagaagattttgtattacgtgagtatacaggacaccacatttttacatttgcattagaaacagatttaacacctagcttacaggaagatggttcaatcgacttccaagatgagaaaaaagaaaaagtattcacattgccgaaaccatatatgaatgattccaatgtggaccagcaatcaggtgaggctgtaacgtcagatgcggttcgctacaatattgagaagaaagatgaaaaaacatatacattaactgttactgcagacccgcagtggttacaagcaccagagcgaaaatatccggtatatgtagatccttcaattgaattggataattttgaaaatgcttacgcttcaagtgcgtatccaactgtcaattattcaggaggaaaactttgggattcaggtcaaaatgcttatacgttaaaagttggatattatgatggaacatctggaactaatttttcatttattaaaccagatgtttcaaacttaaagggtgcaaagattgaaagtgcaacattccatgcctatgcagtttggcattattatgcgcatcaaccaaatggtgtttggttagatgaagtaacaagtggatggaatgttggaagtgtaaactggaataacaaaccaggttctaacaacattgcacacgctgatgtgggccgcggaaaatgggcccagttcaatgtaacgaatacagtgaaagcatgggtagaaggcgcgagaccaaacaatggctttaagctacatgcaaatggtaatggtcaaaaccattggaagaaattcattgcagctgaaaatggaacgaatgcaccattcttggaagtgaaatattcctacgcaaaaccaaataagccaagagtacaagcttactcaaatggcagtgggagtggttctggtcacttcaatgtacaatgggacgcagttccaggagcaacaggttataaagttgccatttttaatggatatgactatgaatatattcctgttgggaatgtgacaagctggacgacgaaagataaaaagatattcccgacgccagaagaaattgcacaagggcgttactggatacatgatgacgggaaaggtgcagaagcgcctactaacccaggacaaatatataaaaatgcttacgagtcaggaggtccgtacggggattatagcggaagaagtagctactggattcgtattgtagcagagtatccgtttggggatagtccactttcagatgaaatagttccatttattccattagaacaagtgaaaaagccagacggatcggcctacattaatgcgacagataaggaaacaggatatgtcacattaaagtgggatgcagttccagcggctgcaggctataaggtttggatttataacggaaaagattacgaagcgttcgatgtaggaaataaaacaaattggacaacgcaaaatgagaaaatttggccaacgaaagatgaaattgcaaaaggccaatatttacttcatcatgataaaaaaggtgcagaattagcagttgatccatcacctgtgtataaaaattctggcggaatttatgctggctttaaaaattattggttccgtgtaacagcgtatagtaaagccggacatgctgaaagtgaaatttcgcatgaatttgtacctaaatttgctcaagactttgggtttatagggatgtttgattactgggcatcagttccggtactaaatggcacagtgaatgctacaaatggtaactttatcatgagtgaaaaagatattacgttatcagggcgcggaccggatgtatcagtggaaagaacgtataatagccaaagtaaaaaagtaggtctatttggtacagggtggtctagtggattagaagaaagaattttggctgaaggaaatggaaacctactattaatttctgccgatggcgcaaatattacttttactagaacgggagataatacgtaccaagctcctacaggtatatatttagaaattaaacaagtatcaggcggatatgaaataaaagataaagaccaaactgttactttctataaatctggagatgcacaagggcgtatcgagtatacaaaagataaatatggaaatacgacgacatatgagtatgatggggaatcacgtttatcaaaagtaaagaatgcttctggtaaagagttagtcgtacaatatgatggaaataataaaaaagcagcaagagtaatcggcccagatagcaaaacgattacatttaaatatgatggagatctactcgtttcttctacaacaccagaaggaaaagcatataaatacggatatgataatggtttactaacatctatttatgatccgcaacatacagatgcaaaaccatataaaacatcatatgcatacgagaataataggttagtaaaagtaacggacccattagggaaagctacgacattaacatataatacagatgcgaaagaagttacgttaacgaatcctaaagggcgtaaaactgtttatacgtataatgatgctggaaacccagtcaaaacagttgaagattctgggcgtctaaatttaacaacaacgtatgaatataatgcaaataacctagtaaaaacaacaactcctaaaaatcaaacagaaacagcgacctatgatggtaatgggaatgtaacttctgttactgatgaaatgggaacagaaaagtttgagtacaataaagacaacgggcttataaaagcgacagataacgaaaatcgtgaaacaacagttgcttataaggctgcaaatacagaagtatctgaaacagaccaagcagcaaatacatcatctttcatgcagtatgatcagtttggaaatccaattgcaacaactagagagctgggaacaggagaaaacctgattcaaaatccaagctttgaaatgaataacactgagagatggaatgaagagaagactaatagtcatggatcattgaaaaaagatgcaacattcgcgccgggtggattgggtggatcttcatctttacaaatgatagtaaaggcgcaaaacgctggttggggataccatagtgcaattcaagatgtggtagtagaaccaaatacaacatacacattaagtgggatgatgaaaacatcattaactcacgccggtgcattttttaatgttcagttattaaaagaagatggaacccctcttggaagtgggaataactggtttgatacacgtcataataggatagagggcgagaaagattggacgaatcgccaagtaacctttaagacaacagatcaaacaaaaaaagttagaatatatctacaagttgattataatcgagcagattcaagtggttccgcatggtttgataagattcaactagaaaaaggtgaagtttcttccagctttaacccaattgaaaatagtagtttagaaaatatggcgggaaatggctgtatgccaggttggattcgaggagatggaacaagctgtgatccgaaagatgtttctcagcaagagagctttacgggacattcatctattgtattagagcgtagccaatatggtggttcagatgtaggatatggcaagcatatcactataaatcagaaaaaagcagaaccaattacgctaacaggaatgtctaaatcagtaaatgtagaaaatactgcaccagataaactctctcgagattactctatttgggcagatgtacattatcaagatggtagtggggaaaatttccaagcgaaattcccaagtgggacaaatgattggaatcgtagtgcggttgtaatccctgccactaaaccaattaaacgtatggaagtttatctgctctttagaagagagaataaaggaaaagtttggtttgatgatatacgcctattagaaggaaatgctcttataaaaaatgagtacgacaacgatggaaatgttgttgcgacgtatgatgaagaaggacagaaaaatacattcgcatacgatgcatcaggaaataaaaagagcgagacagatgaaaaaggaaatacaaaactatatgattataacaaagataatctattaacgaaggttacattaaaaaatggtacctctgtaaattatcgttatgatcataatggaaatacaacagagaaatctgtcatgtttggtgggaaaacacaaacacacaaatatgaatatgatgtagataataaaaatacagtgtatatcgatgcgttaaaccgtcgtattgaacatacgtacgatgaaaatgcaaacaagattaaaacaaaaatgccaaatggatccattttagaatcaatttatgatacagcagatcgcgtcgttggcgaaaaacgcaatggaaaagattcatttacatttgaacgtgatcaaaatggacaagttacgaaagtgaaagatcttgtcaatggtgtagaacgcacgaaaacatacgacaaggctgaccgtgtcacaagtgcaacagatagccgaggcggaaaagttgactgggcatatcatgacaaagcaaacagtaagacagaaaaactaaaagaacaaacaataacgcaaggtggatacacaaataaagtatcgtatgactacaacacgttagatcaaaatattcgtgtgacagacggttctcaaacgtatcgatttgattatgacgatcaaggaaatgttcgtacgtatacagctggaaatggttcaggttctactttcaactatgatcatgcgaacaaaattaaagatttagtagtaggtacgtcaaatagtattctactttctgaacgatatgaatatgaccaagcaggcaaccgtacgaagattaaacatgaaggtgcgggcggaaaagtaacagaaacaaactttgtatatgaccccattaaccaattattaaatgaagcactaccaaacggaacaactaaatcatacacatatgatggatttggaaaccgtacaagtgtaaaagttgtagagaatggaaaagaaacaaaatctatagcggcaacatttaatgaaggaaatcaacttgtaaaattcggaaacgaatcgttaacgtatgatgcgaatggaaatcgtacgtctgatggaaagtataagtatacatggaatgaagatgaccaacttgtagctattacaaaacaaggtgaaagcaatgcattcgcaacgtataaatacgatgaaaataatcgtcgtattgaaaagagtgtaaatggtcaggtaacacgttatttctatgatggagacagcattaacccattatatgagacagatggtagtggaaatgttcttcgtcaatatgtatactcaacaagtggcgcgcgtctagcgatgaaatcaaaaggacaaacgttatactaccactacaaccctcgtggtgatgtcattgcgatgacagatcaaaatagagaagttgtagcaacgtatgaatatgattcatggggtaacgtattaaagagcgacgcaaaaggtatcgcagcagataatccatttggatatgcgggatacatgtatgataaagagatcggcatgtattatctaattgcgagatactataatccggagcatggtgtgttcttatcgatagatccagagccgggtgacgaagatgatcctgtgacacaaaatggatatacgtatgtagataataatccagtaatgttaatcgatccagatggtaatatacctgttgctccacttgtagtagctggagcgagaatggctgcccctcatgtagctcgctatgcagctaaaaaattaggtaaaaaaggtggacactatgtatatagatatgctagaggtcgaggttttgaaaagaaagtattaaaagagcttggattagcgaaaaatactaaaaaggtaatgggccggattcctgatagtttatctaaagggagaattacagaaattaaagatgtccgaaagatatcatattccaagcagtttaaacaatatgcgaagtcaggtaagcggattgatttgatagtttctaaacattctaaagtttccaagccgttaataaatgcgattaacaaatctggtgggaaaataaaagtacgctatggaaaaaataaatattatacttatagataa

SEQ ID NO: 105 - DNA, 3225 bp, Bacteroides thetaiotaomicron
atgcagaatatgaaaacaatagagatgaaacgaactttgtcaatactctgtctgctgtcgttttcccttttcatgaacgggcagcaagcgacaggttatacgaaaacacgtaattatacggcagagcgaacttatatggatgcgagtagccaaacgggtagcggtgctgcacgaattgtcaatgatattgtctataccgacggttttggccgtaaagaacaggaaatacagataggcggcagtcctggaggtaatgcggatttggtactttcttatacctacaatatgatgggtcaagtagagaaggaataccttccgtatgcaaagaccggcaacaacggtgcctttgataagttttccccggagcgttggagtgtctacggtacgggagaacaggcatatgcttataatctgactcaatatgaggatagtccactgatgcgtgtttcccggaagatgggaccgggcaaggcgtggcataccagtgataagagtgtccgtgtgacttacggaatgaacagtacaaatgaggtaaagtgctataaagtttcttccagcggctcattgatcgcttcaggattctatggagcggggaaactggaagtcattgttgaaacagacgaagatgggcatcggagtaaaacctataccgactctaatgaacggactcttctgactgtatctgtcaacggtgaagatagcttggcaacctactatgtgtacgatgaccgcaattgtctccgttatgtactgcctccagaagccagccatcagctggcggagaccgacacgacggatatctccgtgctgcatagcttagcatacagttatgaatatgataaactgaaccggatgatttccaaacgtctcccgggttgcgctcccatttatatggtttatgaccgtcgtgaccgtctggttttgagccaagacggcaaactccggactgctgatgcaaaaaaatggagttattttctctatgactctcatgatcgtgtaatagaaagcggtgaaatgcttttatcggcagagcaaacgtgtggcgaactgcaattggccgcttgggaaagcgagcattatcttcctgcgggaactcgcactccattgcaatatacggtatatgacaattacaaaccaacggagaatgtgactgcccatccgtttgtagcagccgttggctatgatacgtcgtataccctgtatccttcggggttgaccacaagtacgaaaacacgtttgcttggcacagatgactggttgacagagacaatctactacgatgatcgtagccgtgtcattcaaacgctctgtcattatcctgaaaagggactgcgatatagtcatacagcttatgatttcacgggtaatgtcttgagaaagcaggataacattggtacggatatccttgaaaccgtttatacgtacgatgatcgtgcacggttactaacgaaagccaatacttggaacgggcgttttaccgataaaatcacttatgtatacgatgcattggggcgtctgactggcaggaattatggtgataaggtgtctgagagtttatcctataatatccgtggctggctgactggaatcgaaagtcagcacttttctcaaacgttacactatgttgatggagtaggtgtcccctgttataatggcaatatcagtagtatgacctggcattcgggaagtgaggccggattacgtggctataagtttacatatgacggcttttcccgcttgaaagatgctgtttatggtgaaggagaactattaagcaataatacgaaccacttcactgaacaggtaacgggctatgacaagaacggaaacatcctcggtttactccgttacgggcaaaccaatacaatgagctatggcttgattgataatttaaacttggtttacaacggtaaccaattggagtctgtcaacgacaatgctacgggccatgtattcggtaacggtatggaattcaaggatggcgcaagtaaagagatagaatatgaatacgatgcaaatggtaatttgacgaaagatttgaataaaaagatagctgacattcaatacaattgtttaaatttgccggagaaggtgcagtttgaaggtggtaacagtatttcttacctctacgcggctgatggaacaaaactccgtactacgtataagacaggaaatgccactatcataacagactattgtggcaatgcgatctatgaaaatggtgtgttgataaaggtgttgacagaagatggttacattaccgtttcgaataatcaatttcattactttattcaggatcatcaaggtaataatcgtgtggttgtcactcaaaatggtgtggtggaggaagtgaatgattattatccattcggagggttgctttcttcatcattgtctaataatgttcagccttataagtataacggcaaggaactgaacagagataatggtttggattggtatgattatggggcgagaatgtatgatgcttcgttgggaagatggcatgcagtagatccttcaggagaaaaatatcctgctttggggttatatgcttactgtaaaaatagtccaataatacgaattgaccctgatggaaaagatgattatgttgtaaatgcaaatggagcagtttacttgatgcgtaagactgataggatagtagatgttttatatgcaagtggtattaattcctctcaaaaagcgacgcagcctgatccaaattggaaaagtattcgggtgtttgataaatctatgttgcagggattaacggcgagtaaaggggaaaaggggagagactattgggatcgtaagctttacactacgacaaactcggtatataatgctgctaatgtttttttatttgttgcggataatacaagtgtggaatggactcttaagggaggttatatggatggaaagagaacatttatattaggtacaaataataataggaatagagtttcaagtatgtatggattaactaaagtgcaagaggctttatttcctacctttataccaataatagatatccattctcatccttataatccctttgcttcacctgaggatatggataatgctagaatgctgagagatatacgatatggtatttattataaagataatattattaattatactgatcaaaacaatagcacatattctattaaagttaattccatgaatgatttaatgcgatatatatttcaacaattaagatga

SEQ ID NO: 106 - DNA, 7509 bp, Caenorhabditis elegans
atgaacaatggtgatccggtggctggtggtcccatggctttatcgaaaaagaagaaaaagtttgacgacgatagcgacacgtgctccagatggccatccaaatggaatattttgctagccgccgcgcttcttgttgcactttttgttatttgtattttgcttttccgtgctccaaactacgtgtacacccaacctgctccctcatcagacgccacatcatcagctgccgccgccgccagtcgatatcaagatcttggtcttcgagcccttccgccagcaattagtcttggtgaaagagtcgacgtggaattttttccaaagtctatggcaacaacagagctcaccgttactaagccttcacggatccgattcaatgcaacagttggatcaggtgctcagctggttcttctaatgagtgctggagttcaccccagtctgagtctccatgatgcactttttccaattcgtgctgacaggattcgtgactcaaaaagccctactcatattgtagaagaatttgggtcacgaagtcgacgtagcctcggagcttcatcgtctcgacatcgaaacattgaaattctgtccccacgaagtgccacgtttgaacaattcgttcttgaaggacgtcactatctgacatttatcaacgaacgaagccgagttgaaccaatttcattcgttgccgaagaacttcaacgcccaacaactcctccgaaaacttcctcatctggaacctcaggagcaaaagagcatccattagcatcagttcttgtatgtgaatccaactgtaatcaacgtggagaatgtgttcatggaaagtgtcattgtgctcctggtttcacgggccgaacttgcgatgaagctgtatgtccagtcgtttgcagtggaaatggagtcttctctggtggaatttgcgtttgcaagtctggattcaaaggaaaggaatgtgagatgcggcacaattggtgtgaagtagcagactgtaatggaaggggacgatgtgacactgacggaagatgccgttgtaatcctggatggactggtgaagcttgcgagcttcgtgcatgtccacatgcatcgtgccacgatcgaggtgtttgtgtgaatggaacatgctattgtatggatggatggagaggaaatgattgttcagtttttgctgatgcaattgtacatgtcccacaagcacagtctccaccgagaagaggtcaagagccaacggaatcatctaaaactcggaaggctcaagtgaaaccgactccaacttctgagaagaagaaagaaagccgagagcttcaaaaaccaataattgccacagttcaagttcctacagaatcaagccatccgtgctcagctcatggtcaactgattgatgacatatgtcagtgtgagtcaggttgggattcggtagactgttctcaacaagcatgtcaatgtgttaatggagactgtcttgatgatggatcatgtcaatgttggaaaggatggagaggatctaactgcacagataagaaatgtgcgattggatgtgaagatcgtggaaaatgtgcatcggatggatcatgtaaatgttcttctggttggaatggagaaaactgcgccattgatggatgtccaaatcagtgttccggaaaaggcgaatgtgggatggatcgtcgttcttccgaatggtcatgtcgttgtcaagctggatctactggtgttgactgttccgtttccgttgaaatgcattgtgatgatggacttgataacgactctgatggtcttatcgattgtgatgatccggaatgttgctcatcgtcatcttgctcttctgaatctgtatgttctaccgcagcatctcccatcgaagttctgatgcggatgccaccaatattcaatgcaaactttgctcaaagagttggatttttgataatggaaaagtcagtgcaaagctatacggattcatctcagttcaatgagaacttgatttctgtgattagaggacgtgttatgtggggtggatctccaacaggttcggacgatctttccacatattccaataaatctacagttccacttgtcggagtccgtgtctcggatgcagctcatccactttacggattcaccttgacaagagaagatggatattttgatcttactgtcaatggagcacgaagtgtcactcttcaatttctgcgaacacaattccagtctgtcaagaagagcgtttttgtttctccccgtcaaattattcacattgatgacatcgtgctctatcgtcaatctggaggatcaccacctgcaatatcaatggcaccggcacgcgcaaaatgctcgccaacgttgagaagaattccagatgttgtattgatttctaactggcagtacacatctgatggaattgaaactgacgaaacctctgattcttctcgaattgtcgttgattctagatcaatcttcgagtcattgccaattcaaggaactgatgttcgacttgtatatgattctgcaagatcaccagctgctccatcaacaatgctcataggattattgtatgatcgagtcgacaaggagctgcgcaaagttcatatcaatattcggattgccggacggcggtttgatagagttctggctccgcgtaccaatctcacttatgtatttgcctgggataaaatgaatgcctaccgtcaaagcgaatcaggattagttccagtaacagttcgagttggatatgaataccaaggatgtgatagaacaagtgaaagggtatggcaaacaagaagaagtcaaatgatgggagcaactgctagaaaaatgattggaacaatgtggactcttgatatacatcatcatttggatattgttaataatgtcgtcgagatgggaaatggtggataccgtttaatcactgaaagtgagccacgtgtctcaacatttgcaggacttgatggcgtgaaacgagatgtggaatgcttgaaatgtgaaggaaaagtcgactcaatttctctcttccgcccaactacagtagtttatgctcaagatggaagcctaattattggagatcacaatatgattagaagagtttcacaggacggtcaagtctcaacgattctaacattgggattggcagatacttcacattcgtactatatcgcggtgtcaccggtagatggtacaattgccatttcactgccacttcataaacaagtgtggaggatttctagtcttgaaccacaagattctcgaaacaactatgatgtactggctggagacggaactgtttgtgcttctgcagtcgactcgtgtggtgatggagcacttgcacagaatgcccaactcattttccccaagggaatttcttttgataaaatgggaaatttatacttggctgatagtcgtcgcattcgagtcatcgacactaccggacatatccgatcaattggagaaacaacaccagatcagcatccgatcagaacttgtgctcaaattacaaaacttgtcgatcttcaaatggaatggccaacatctctgacaattgaccccataactggatctgtattagttctcgacacaaatgttgtctatgaaattgacgttgtgcatgatgtagttacaattgctcttggctcaccgaccacttgtgatcttgccaatgcaacttcctcggcttcagccaaatcacttgatcatcgtcgtcacttgattcagaatgctcgtgacatcactgtaggaacggatggagctatttatgttgttgaatctgatggaagacggctaaatcaagttcgaaaactcagctccgatcgttctacattctccattctcaccggtggaaagagcccatgctcttgtgatgtggcagcttgtggatgtgacgatgcagtttccctccgtgatgttgcagcatctcaagctcatttgagctctccttacgcggtctgtgtttctccttctggtgacgtcattatcgctgattctggaaactctaaaattaagaaagtatcggcccgtatggcaaaatacgatggacgttctcgaacttatgaagtaactgatgctgagcgtcaggaaaaatacacattcaaccgtcatggacaacattcttctaccgtatctcttatcactggacgcacctttttcaacttcagctatcaagttgactcgccaatatctatgatttctgagatcagagcagcatctggagttgttcttcgtgttctgaaacgaaatgattcactcttcgatttggaaactaccctcggccaaagaactacattgaccatgtcagcatatgatggaactttggagcaagtgtccaagagagattctgcaacttcaagagacgcaacaaaactgttttacaagaaaggattgttgacttcgagaatagatgtagctactgcagttggatttgaatatgatgaatatggaagagctattggtctgaaacgtgatagggaatattggagactcggagaggaaacgatttctatgggatcagtgaacactgaagtacttctcaacggacaacgcttccaacaagttcggctcggtgaaggaaatcttgcagttcattccacaaatggtgcaactactcgcctaattagcctgcgcaatgaaggatactcattggcatcaccacttggtacatcaacactttacgacaaaagctcaagtataccggatagtaacggggagccattgatatcacgtcgaagaaccaaagttcctgcaatcggaaacccacaaagaagagaactgacaactcgatgggactggagacacgtggctcgtcgtggtgatgattcggatggcagtttgggaagacgaaaagtggcggagattaacggtgtgaacatgttctcaatggaatatgatgttaaatcgaaccaagatactcttcgtcttggctcaacaactgatgatgctcaagctcttctctttatcgactacacttcatctggacgcattcgtcgcatttctgccccagaagattctcaaatggctgagatgaatatcacttgggatggagctggaagaaaatctgaagttacttggggatcttggaagattcgtcttacttatgacaattcaaaccgtcttactgagcatgctattgatggagcaagagttccaattaaaatgagctatgcaggagcttccaggagaccgaatgagattcaacatgacggagccaaatggaacattcagtacgataactatgatagaatcaaggaagttatcagtaaatctcaagaggctacatcattctcttcaattgcgcttggtggggatgaatgggtcctgaaacgaagaacctcgttaaactccaagccatcacttgttagattgagtagagaagggaaagttctagagtcgacaacacctgatgaaaatcattattggcttgagagaaaagaccctattactggaagaactactgagatattgaatgacgaagagactactgtagtgacatgctggtctccagaaggtgcaccaatgtgttctcggagcaggaacctccaagaaaatacaacaatgcaaggacacctggttgctaggaaaagcgtaacaataatgacaccaacatcttcagagccttccataacttcatcgttcacttatgaatacgacgacatgctgcgcgttaccacaattcagccagttatcgaacaatccgtacttgaatctattcaactgtcttacgatgaacgtcgcggacatgttgcagcaatcaatggattcaaatgggcgcgcgatgcatcgacttcccgttgtcaaggtcatggattaatgtacgaaacttccaaggcaaatgatcatcggcaggttgttgaacgtaagctgatcttcggagatgcgagagcttcaattaaaataatacgtgacaaagctggaagagcttctgaatctcatctggagatatcttcatcaggaactcaacggaatcagaaaatcacaagaacttttgatgctgctggacgtgttgcaagtgtcgagcagaatgatcaggaaccggttcgaattatttggaattcagatgcacgcgttgagaaaataaatgatagagttgtggagtggaatcgaggaggtgctctgaaaaccttccaggatatatcttaccaagtcgattctatcggatgggttgtaaagcgagataataccacagtgtttggatacgatggaaaaggacgacttgtttcggctcgttccagtcagctcagaatcaacattttttacgatagagaagatcgagttgttcaaattcaaaattcgaaagattttattcacttctattatggatatattgacactccaaagttggtttctcatttctcaaagaatggaaaaatctcaacattattttacgacgacgattccgttccatttgcaatgcaatctgatgatggaactcgctatgcattgttaactgatgaaacttccaccattaaagcaattatcggagactcgaatgttcttcgaatcattgatcgttcagttttcggagctctacttccttcgtcatcgtcttcgcacccattccttcccattggatacctcggtggaattgaaatttctgagatttctgtgtcaattctgaataatggaagaccgttggatttatacagtgaacgttacatgtcaatttctccagaagcagtagttcgacttgagcttaacgaaaagttttcgaattctattgatttgatggcattggaaattgacagacaaccattccgcgttgagaatgttccagaagatttcgaaacatggttttcacttgccggactatcgccaaatcttctcccatcagctcatcttggccttccagcatcatccgctattgttcacagacttttgtcttctttccctcggaagctccgcccacttactcacttgactaccgtacttccaacacgattagcctcagacatatccctgacatctccaacttctgaaacttcatggtcaattgatgacgttggtttctcaaatttgttaattttgaacgaagatgctacaactggagaggttatggttgaaatgctatctgatttgaaatctgaagaacgcgaagtcatttcaaaactgtttgatggagtcaaatctcttgattttgccacgtggggtctggtaccaacgcgtcatttgtggagagctccgaactcgaagctagagctcagctcgacctcattctcacattttacaatggccgtgaacaaggacagtgtggagttgagaaacggaaaatcgaagattgttgtccacttttcggaaaataaagctgaaattgttaagaaaattgtggaagagctgaagacacgcgagaacattgccgtttggcgtgccgaacggaagagagctgaagctggagagaaaacgtggagacaatggagtgatcgtgagacacgcgaactaacttcgaaaggttctgtctctggatacgatattgagatgaagcctgcccaccaatccggactcctcgctagtgtacattcatggaagttccgaaaatctgaatag

SEQ ID NO: 107 - DNA, 6738 bp, Cellvibrio japonicus
atggtgttgtcaagttattttgcttttctgaaaaaaatctgttcttttttaaaagttacaatgggtgcgttattcctgtttgcgttgtgtagtgcaacatgggcgggtggagtcaagttggggcaaggaaaactggtttctctggcagaggggactttattatattcctcaccaggcagtgctaatcggggtgatttcggtcgagcagaaatttcccgagatattattgcattagcagatagtattgagttgatggcagaacgtaatagttctggcttggttaatgccagttatattgcccatgcttatgcttatgtgaaaagtgagatcgcaccggagttccgttttggattgagtaaaggaggttttggagcattactggataaatcaggaacaccttttgatcaagcacagttgttgcgtgatttgctggctgcaaaatctatcagtgctaattatgtattgggcaaggctaccttgaccggggaacagtttcaggtatggactgggattaatacggcgcgtgaggcatgccgtttattggctaatggcggtattccggcagaggtcaatggtacattctcggcagattgtgattatgccggcgctgtatccagtgtggcatttttacatgtctggttaagtgtgaatgttgcaggaacagtgcaactgctggatccatcatttaagaaaatgacccataaaaatccactggatctagtggcacttacaaactatagccgttcagcgttagcgatatcagctaaaaacagtaatggttcctggaatatttccggtcttaataatgcactgaatggaattgcccagacttattatcagaatgtaaaaaataattatccgaatcaatccagtctggatgtgctggggggaaataccatcactgaaaaaatcgttaatgctacggccggtgatttgactggccttgcgtattctggtcagcagatcaattctgttgagtctattcctgatcgtttgcgaacaaagctaaccctttcacaactatctacgcccaacaatactgtttcgcctaaagtgttcaatttttttgcagatgaaacttatggcgctacgatttcatttgcaccgccagctcatgccaacgcttacgattatgacaatatctattgtcatatggtgtttgatggcctcacagaggttcatcgcagttatctacaatttgcatccatggttgttgaggttaaggtcgaccacccttacctgtctgcgaatgaggcgggaacgaccagcagctatatggataacacctccaggtttttactcaattgcaggatgcccaatacgctcgttctcgggcttggaaatgcgggtaaggcattggctgaacgccatcaacaacaagctaaagaaacccgttataccagtagcttcggtgcggagaatggaaatcctatcctgtcagattttgcaatggggtggcagcagatcatacctgtcgccagtgagtatctgtatgaacaaacacaacgtacgcaatttgttgctgcgctgggtaaagccaatattgaacatcatcatacagtcggtttggcatcaacgctggtcaagattgataagcctgcaggaggtgttgccagtgtttctcagcagtcactggaattaagccttgatgcggccatgagttatacgcccaaagagccaattaatgtgttgtatccggatgatattcaaaatattcctccccaagtagtgagtacctcgggttgtacatggaacctggtgcattcacagtccggtgttgtggcagtttatcaattaagttgctatggaatcataaaaactattacctacagcgggtcaacacaaaactgtagtttgacggctggagcaggttacaacgttagtggcaactgtaacaattttgtggtgacccaaaatacaacactacaggcgtcccaggcttatcccgcaaacccaattcgctccggtgttggccgggccttgtcctggttgctggcaagcctggagggtgaggttacccaacgtattaatggaggtgttgatgcttattcaacaacacatcgttttgcctggggcgtagcgaatgatgtttccttcggacaatactcagggggagcaactattccacgtccgaatgtgacgatctttactgcacctgagaccagcgcaggcacgactatcagtattaatttggagcaaagcggtggggttatcgccgataaaatggttgaggttgctaccgcctataaaaataaaggctacaaaattattatgccaggcgttgccgttatgggaccaggcgagtttgtatggtcgagattttacaacagttgtacaggatgtgtagctggttataactacgtggctgacctgggtatgcaatacggcagtgctatgtatgccgaaaataaccaaaccggtgattacgttcactatatggtggattatttcggtatgaatcgcggtggaggttccggtacccgtgctgcaccaaccttggatggcggcaaattggaagcccctaaacccgatagccgtcaaaagatagagcatggagtacagaagaatactggcgatgttgcctataactttaattcaattatttctgtcgggccggaatttccgtatgggctgtcggcggacattgccatcaaaaccaaacgaggtgagcctgagtttaccgccaccttaacaccgggtacgaatactggactctggaagcgtattgagcgtcaattcgaagtaaccaatgccggtagtgccagctttgtgagtgacagtattaatttgctgggcaagagaacccctctggaagcctcctatgctgttgctgcagtaatggcactgttggatattagccactcgggccggcaagacctgcatgtgtttaatgcacttattgcaaaatggttggcagatcaagtactggagagtaccgttaatatcagcagccctaatggctctgatgaatatgttcgtcatgccgatggttatttctatgccaaaccgggctcaccagagtcagtgactgtatcacttacccggaatctggcgccgtcgggcgtaggccaaagttgtaatcttagtacatcctccccgccgaacccgaatgatattgagtggttaagatcgggatattcacgaataattattggtgatgttgttcgaacacttaagaatggtgataaggaaaaatacaatgcacgtagctatgtgacctcacggtttgattgctcagctaaaaatccgtggcatccgcttgtgcaatattctaataataaaggggtggaggttaattatacgtacaatggtttcaaacaattaacagctataagcaataatctggggcgaacactctcatttgttcatggtggacatccagatacaggctacaaccttaccattaatagtggctctcgcagtgcatctgtcagtgagaacatcagtgaaaacagcatagctataaccaaatctgatggaaagcagtggattgcaaagctggcaaatcctgcccaggctggcaaattgatattgcatggccaggcattggaggcgatctattctccggaagataccgataacccaattgtccaatatcattacaataatttgtggcaagttacagccgttgacttgcgcaaaaatgaaagttcaaattggaataatgcatatcgctggggtgtgttacccggttatgccaatattgaagttgatatcgctgactcaaaaactatcgattattttgataatacggggaataccgtctatcaaaaagatgccatgaatcactttacggtgactgcgcacgataatactcatcgtgctgtagatcgacgtattttcgagtcttcagtagcgctacgagcgattagtaacctcgcacatccatggccatccgatctgcctggatatactgcttataatgggagtttttcgaaacgtgaggttttccaatatgacgccagctctaatattaccaaagaaatgttgtaccccaagattggggcgcccgatgcagatcaacccttagttattagtcgaacctggcaacctgtttacaacctcctgaaaacagaaacctttcgttatgcagagggaaccacttctcaagtatcggtaacaaaccagtacaatgttacgacaggtgtcctggagcaatcgacgaatcatgcaacaggtctgacaacaaactatgaaaactactggatggggctgcctaaattaattaaagagagcagcgtcaggcacatagcgctgacttatgacagctatggtaacctcaccaattataccgtccaaaagccagacggctctggaaagattacaacaacggcagaatataatgatgccgtttatggaaacatcggtaatgtcagtaagttgactgatccaaatggtaatgtcacccgtgcgcaatacaatgctgatcgaagtttgaaattccgctgggatgcacaaaataccaaaactacttttggttataccctggggggacagctcaattctattcttgtggatggcaatgcgcgcaccagtgaggttacagctggttacaatcctttgggctggatggtatggctaaaagacgctgatggtgatacccaatattttgattacgatgcacgaggattactggaaaaaagtacagaccccatggggcgggctaggcgttacgattacaatcgtgctggccagcttatttgccagcgtgatggttggggtacaggcttgcagcgtacctataaacatttgcaatacaatgctttggggctggtgactgcatacaacagtgcagattcagatcctaatagtgattgcgtgttggataacacaaacaagcagacaacggttcaatacaatgcctatgggcagctctggaagactactttccccaacgaatctccccatggtattacctacgagcaatttgagtactggcctggcggaggtgtaaaaaccaaggttaatcgccgtggtgaaacggttagctatacctataaaaactcgaatgccaatccttctctggttgatgtcaaaacggtgggggctggcagttctttatataccgtcaattacaccagttatgatgtgtttggtaaaccgacagccattagccaaacaggcctgaatccaaataccttaacctttacctacgattatgcagatcgcggtgttacagagtctagccagaaaattggatcctctggtgtggtgcgtaaggttattaatcgttatgacgctgctggcaatcgtagcgaaatagtttggcccgataattacacagttaaatatgtatacgatgcattaaatcgcattgatcaggtcaatgccggctcgctcaaactggcagattatgattacgacgatctgggtaaccttgataaggttacctacggtaatggcgctgtatcggattatcaaatccagaaagatggtgatttggattttatcgagcataaatttgtcggtggaagtaataatgttaaatacacctatagttttaatacagcggcgcaactcatcagcacctcgctcagtaatcgcagttttcattggcgtgcaccgtcaactactgaaaagttatatggtgtcaataagctaaaccaatacaccagtgttggtggtgttgcctttaattatgacaaggctggcaacctgacaactggacagctggggacgttccagtacgatgcggaaaatcgcttattgcaagcgaatattggtgctgctggtccacagggtgcattggtggcaaattatacgtacgatgctaacggacgccgtacacaaaaaacggttgttaagggaggtgttagcactattacggattatttgtccgatggcgatcacgaaattgcggaatatgccgccaacaccagtacacccagtaagcggtttatttatggaaagaatgtagatgaaattattgccatgcaagatgtggctgccaatacctatagctatgcccaccgcaatcaccaaggctcggttattgcggtatccaatgccagcgggcaggttacatcgaataatatttacacctatagcccttatggtgaggtaaatagtgcagcaggttttccattccgttataccggaaggcgcttagatccagagactggattgtattattatcgtgcacggtactatgatcccggcttagggcgtttcttgcagacggatcctatcgggtataaagatcagatgaatctttatgcttatgtgggaaatgatccgcttaataagatcgacccaacaggaaaaaatgcaaaaaaaccatttttaaaagaggctgcgaaagagcttcgtaaagaagcaaaacgacaaataaaaaatgctaaagctcaggggcgccgtgaagcgttaaagcaggaaagacaacaactcaaggagactggagagagcaaatccaatttgtcggatgatagaaagacagagcttttagaaactggtaagttgaaaaatatggatggtcatcatgagccatctgttagctcaggaaaaactcttgaagaaaagattgacattgctaaaaatccagacaacattaccttcatggagaaagccgatcatcaggcaaaacatgccgaaaatggcggcactcaagtccctattggtgctatagcgcttggtgttatcgctgatggactggacctcctttcacaaattcccgatccgacaattatattttcggttcctaaggttggttgtgcagagttaaattgtccaagcgaataa

SEQ ID NO: 108 - DNA, 6612 bp, chloroflexus sp.
atgctctggcagcggcgagcacagcgatggtggtcatggtttgtcgcgtggatattcttcataaccctcctgccaccaacagggatacaggctgatccacaacagccgccagtcaccgaaccaccgcccgccccccccccccccgcagcggtagcttccttacagcttgctccacagcctcctgatccgggtataccaaccctggccggagctgttaccgtttcacccgatcccctttcacctggaacccctgctctcatcaacgttaccatctggaatcgttcaccttacgtcgcccgtgatgttactgttacgcttgcagggccaaaagggatattggccggacttcccgccgagtctgctgacactgccacaaaggcagtagccgtcgtctcacctgctgaccatacctggcaatggtcaatcgctgaactggcaccgtatggaacggccgtgcttaccggaaccatacaggttgatcagccgttagcggggcaggcgattgtcctccagggccagattcaagccgccggtgttgcagaaccatggttcgtgcgtggtggcgcactgatcgataccaaaccactcacgaccgaaacaacctttgatccaggacgtacagcaacgctcaacctacctgatgcacctgtaaccgttgagatgccggcaacgctgagtcgtcgtcgtctcactgtacggtataccacgcaatctgacaggagaagcgttgtacctccaccagagatccatggacgaccacatctgggtactttttacctggaggccttcgacgagcaaggcaaatcggtcagaaccttcgatgcaccgctgaccattcgggtgcggtatacacccgaacaacttgctgcacgcgggattgccgagtcagacctgacactcttctacttcgatgaagaacagagccgttggataccgctgccgacaaccgtggagccggcaacagggatagcctgggcaaccgtcgatcactttactcccttcacactcggcgatggatcgacgatatcaaccacgtatgttccttcattgcaaggctttcaggtcggcacctttagcggtgcaatgagctacggcatccagatcgaggttccggcagggccaggcggattgaaaccggttgtcagcctctcgtattccagtgcagcctcagatggacctggtggattgcgtgaactctggcaggccggtccggtcggcaaaggatggtcgcttaatgcaggcggatcggtcatgcgcaacaagagcctggccggtagtaactgggatcacttctcactggtatttgagggtcgttcattcgacatcgtgcgcggacaactgctcagcccatgtactgactatcaaaatggagccgcacttgagtgttggagctggcatgcggtcgatgagcattttgtgcgggttcgggctgagcagtcgaacggaacatatatctggcgtgcctggacaaccgatggtacccgatatgattttacgcaacctctctggaatcgtcccgatacggatgtcaatacaccggagatatacggatggctgctgacccaggtcgttgatgtacacgggaaccggatcgaatacctgtaccacattgatgtcgtcccgggaacagtttttaccccaacctggtatctggccgagattcggtgggggtttgacggagcaacacctggcaccggcaccccacgctatcggattaccttcgagacggccgatcgcgcaaccgggatcagtgcgggagtagatgcaaactatgaacacccctacccagggaatgcatactggcggcagatcacacctcaccaaaaataccgggttgatagcattagcgtctggagtaggccgggagcaaactacgaactggtacggcgtctcgttttatcgtatgcctcgctgaacgagagtgttttcagcgatgcccgcaacggccagcgcgtgttaacgctcaaggcagtccaactcgttgggagcgatggaatacaggcattaccggcaacaacctttacctaccatccacgagacacctccgtcaatgcacccaatcccggcgcgaatcgtttggcgacgatcacaaacggtcagggtggtagcctcaccatcacctatgaaaagacattcccagcgaacagtagctggctggaaataaactatcatcgggttgccagcgtgctgcgcagcgagacggcaattcccggcaggtcaacccagacccttaccacgtacagctatagcgccccggcgctcaatacacgaacccatgcggcaaccgtcgtgtttgctatgtatccaccgagtggcaacggggatagccgccaatttatggcccgccccgaagcgcgggaatttcgtggtcatggtcgggtcattactcacgtctatgcagggaatactacgtccacaccgttactcaaacgtgtggttgaatatttctaccaggggaacggtggtcccaatcttgacgcatttcagacctgcaatccagcgctggttaccctcccgaacaatcgcctggcagtcaacgagagtgatccctgttttcagcggatggtcgtgtatgaagcctggaaagggcgaccatatcgggttgagatcactgatgaacaagggacactcctccagcagacgacctttagctatctccacgttccactccccttctttggcgcagatccacaggtgccaaattcagcaacgctcagtaacaattatcggcgagccgggttgtggcgtgcttttagcggtgagcagcaacagtgcgtcaatctaccggccaatgggtcaagtgttgagcgttgcacggttacgttttacgacctttcccctggtcacaacactaacagcaatcaacaaccttacggcaatgtcacgcgtcgcgatcttatcgccaatggggtactgatacgcacgacacgacagcatcataccatcgttgaccaggggacagtgtatctaaccaatcgagtgtgggtaacagtggtcaccgatggacaggggcaacgcatcggtttcagcctgcgtttttacgatggtgccacgacccaggccggcattgggacacgcggcttgctgacccgtgagatcacgttcaatgtgccaccgggcacaacaactatccccaacgggatgacgatcagtggacgggatcacacctttacctatgatgcgagcggacagcaggtcaccagtagtacctacagtggagcagctaccgccacctaccagaacggtacgtgggtagtgagcgcaccgggaggtggcagtcctgcacgaactgcaacgaccgtctatcatcaggtctatcgctggttgccggtgcagtataccgatccaagtggcgctaccagtcgggcagtgtacgatctccgcctgggcacactgattgaggttgatgggccgctaaatggtgacaacagctacagttgtacgaccagtgcgccagagacaatcattcccacactgacagacgatgtggtgtgtgcaacatatgacgttttcgggcgcacgacgtcaatcaccaggccgggagatcggcgggtggagccgtcgctgcggatatggtatgccgatgctgaactgccagttcgctataccctccaggaacgcgacggattgagcagcagcgatccctaccggacaacccatcacttttacgatggatttggccgcttgatccagactgcccaggaaacgagcgatgggacagccatccaacggattattcgagagaagcgctacgacgctctagggcgggtcattcagcagagtcagccatggcttgtcaatggcatgggggcaacctaccagccacctgatgctcaggtacgttggacgatcacaacgtatgatgcgctagatcgcgaacgtcaggtcattgatcctctgggacataccacgaccataacctacggggtaggaggaacagggagcgaccggtataccataaagactgtcttgacaccacgcggtgtgcggactgattaccgacttgacgcccaagatcgattagtggaagttctggaatacccctttagcggtacagcaagggtcacccggtatcgttactcagccctggacctgctacgggaagttgtgcggagcgatgggagcataacaaccattacatatgatggtcttgggcgaaaaacccagctcaatgatcccgatgtcggcacctggttgtacgtctacgacatcaatggtaatctcatccggcagattgatccccgcggtcagcgactttgctaccgctacgatgttgtcgatcgcctcatcggtgtccacgagcgacttgatgatggctgtccagccgatccggtacacgatcaatacgtttaccgctacgacaatgctggacgcctgatcgagcatgccgtcagggatggtgtcacggtacgctggaactatgatgcgcggaatcggcgccttagtatgagtcagagcctgccggcgcagccaatgctcaccatcagttggagctattacgccaacgaccttgtgcagagcgtgacatatccggacacgaatggcacaagtgagatcgtcaccacgagctacaacgccggctggcaaccgactcagcttaccagctcgctcgatggggttattgtcagtcatggccgatacaatgcgcataacctgttgaccgatctccactacccgaacgggctacgtgaacgctgggactacgacgcagcagcccggcccacccgctggctgctgggaacggccagtgcgccggggagtatcgttgatcggagctatgcttatgacggtcatcacaatctgacgcgaattgccgaaggaagcgccattcagacctttgcctacgacgatcgggatcgcctgatccgcgccagtgtgcttgatgccaccacccgcagtccgaccctgaccatccgggcacggggcaccgcagccggcggggtctggccgagcatggcgctacggatcaacggcgccatcgtccagcgctggacggtcaccagcacgacctttcagacctatacctatacccacccaacccccctcgacgccgatcagaccattgacctgctcttcgagaacgatggtgtggtggggaacgacgaccgcaatctcttcatcgacaccattcagatcggctcccaggtcattcatgccggccagcggggagtcagctatgaccggggggcacttgatgggcgcgacgtgtacgccagcaccggcgcgctctactggaatggcgcactccggctcaccgagcagtatacctatgacagcgtgggcaatctgacccggaaagcagacctgccgatcacctatggcaccgccgggaatggcccgcaccgaccgacgaccatcggtgggcaggaggtgcgggccgacgcggcaggcaatctcacggcggtgaatgggcggcagattgtctggaacgcccacgggttaccggccagcgtgagcacagccggggtcagtgagcaatatggctatgatgcgaccggcgcgcgggtcacggtcatcagcaacggggtccgccagcgcgtcgtcggaggcctctgggaacagcacggcagcagcattcgccatgtctatacccttgggcagcgactggtcggcgtgcgtgacgtcaccagtggcacgtgcaccttcctccacctggatcacctgggcagtatcagcgttgccaccacggcccaggggagcgtcatccggcaggagtatgacccgtggggtgccctacgggtaccggccgtccaggccggccacgtcccgatcacggcgacgaatcgagcgtataccgggcaagcgcgtgacgccagtggattgttgtattataatgcacgatactacgatcccgacatcgggcggtttctctccgccgacaccatcatccccggcagcccgccgctcaccgtctggccgagcgacgcgaccgcgcaggggatgtggcgcagcgccggcagcggcccggtcaatccgcaggacctgaaccgctacgcctatgcgctgaacaatccactgaaatacactgacccgacggggcatttgccgctgctgccggtgctgctcgttggcgggattgcgctgctgaaggcgattgactacggctggacggcgtgggatgccttccaagccacccgcacgctggccgatccgcaggcgtcggtggaggaacgacgcgcggcggctgccaatctggcgctgaccgccacgctggaagcggccgaacctgatgacctgctgccggttggcttgcccctcgatgacttgctgcggcttggaatcatcggggggagcaagggggcggggtccctgcttccgctcggccggtctttcggtcagtatggcacgctcgttgaggacccagggatatcgatcacactccttacgtatcatgctaccaaacagcaccaggtaacgcgggagatggtcgaggcctggcagcagcttcccaaagcggtgctcgcccaacacaatggtcagcgcttcctctgtatcaccagcgaaggtgcgtatgtcatcgaccgggcagggcgggtagtcactgcctacccccggagtgagtttaagcctaaacttatcgaaatcgctaaggagcttgggattattcagtaa

SEQ ID NO: 109 - DNA, 5193 bp, Corynebacterium matruchotii
gtgccggttctcccacttaagcccttcctggcatacaaagaaagcgaattcaagatcggcgggaacaccgctgaagtgtttgatttcgcccgacggtggaaaacctttgccgataatgcgctcacctgcgctagcaacctgcgttccattaacgacggcggcttcctcggcagcgaaggcgacaggtataagcagctgattaacagcgactttccgtcacacttgacgacgaccggggaggcccacaacggcgtgagcacggccgtgcaccaatacgccgaagccctcaccacggcgcaaacccagatgaatacgctcatcacgactgcctcggtgaaccacgccgcagtgcagaccgcggtcgctaactacaacgcgtgcgaaatcaacctggcccgcgccgtagtgaccgcccaagccgccaccacgacggcggccgccaccgcggtggttcccggcgtgaacgtggccaccgccagtgccgccgcaacggcgcaaaccgacctgaccgcagcccaaaccgcttttgaagccgccaagaccgagcacacccgggccaccaccaccttcaacgccgatgtgactacggcctcaaccattaaatccaccctgagcaccgcagtgaattcggccgtgacctctatccggtcgcaggccaagaaacgtttcgaagaaaaccccggctggttagaggaaaaatggaacgacttcaaagactgggtgagtgaacacgccgacgttctgagcatgatctccgatgtattgcaaacgatcggtggattgctcatgatgatcccgttcccgatctttaccgctattggcgccgctcttcttgtcgtgggcgtgggcttaaaagccatattggcgctgaccggtaattgctcattgcttgagtttgccttcgacgtagcaacatgcgttccgggtggaaaggcgcttaaagcattgaaagcgggagggactgcgcttaagggggcaaaaccagcaaaagcaatatctaaagcatcaagcacggcatcaaaagcatccaaggcatcgagcacagcatctaaggcgtctaaggcatcgaatgcggcatctaaaggggagaagtccgcacagaaggcatcgaagactgcttcccgaggtaattcatgcaaatctcctggtggagagccaatcgatatggcaaccggtgagatgattaactttgtcaccgatgtgcatattgatggcatgttgccgatggtggtggaccggaataatagttctgatttggatacgagtatggtgttcggtcctgggtggaacacgtcgttggatacgcgcattgaagtctgccccgataagattctaatgatgtcccccgatggggccatcctagaattcccgccggcaccggcagatggtgctgaggtggtggcgaatggtcgtccgtggcggttgtcgtttgtggatggtgcgtatcgggtgcggaatattcaggagggtattacttgggtatttgcagttacgggtagtgagtttggggatcggcgccctgatgcccccatccaagacttcaacgtcactggcgatgcgccaaagaacgttgtccaccaggttgaagacaccgaagtatccaactcgtttgtgaatgtgttgtcaccgggttcggtggcggatgcgtttggcctcagcgtggagattcgtctttcctcgattgttcatcattctggtgcgtggatcgaatacgactatgagcaaaccacgggtcacctggtatccatgcgacggagtgatggcactactctggaattcaaatggcataaccgagtccaccgcctgctatccatttgggtgaaaaacgaggaaactcatccagatgaggagccgatgcggctcgcatcctacaactatgatggcaagggtcgactcctgaaggtaattaattctgctgctggggcgctgcgttattactacgatgatgcggaccgtccttgccggtggacggatcggaatggttactcttactattatcggttcgatgaccagggccgggtggtatcccaggtggggtccggcggcatgttcccgaatgttgtcatctggttgccggataccggggatgacgcgccagaagacggcacagtgtgcgtcatcttggagtgcgcgggtgagttccatggggatcccgcggagattggtgactcgtgcattaatgaatacttcgatcggttagagaatttgcctttggccaacctcctgcgtgaaaaagggttagttggtgccggtttgaccggccggggccggacgagtgcgcgggatgatgagacctggactattccggaagaattgcttcacgacgagttcctgggagacattcgccccacggtgtaccgatcgacgcctgcgggagatgtgtggcggatcgtcactgcggagggcatagtcacggattgggatcacgaccaacatcaccagatcactcgtcaaatgacaaataccggtgtagtgactgttcttgaacgtgatgaatacggaaccattacccagattgattacggtgatgggacaacagaaactattgttcctggtgcgtggggtgaacctgtcagggttattggtcgggatgggcttaccactgagtatgaggttgatcctgctgggtttgtgacggcagtaacagatcctgctggtattcggttggagtatgaatacgagtggcgggcaacaggattggtaccgttagcgatgattgatcctcaggggttagtgcaggtcacggagtgcgataacgccggtcggccgctggtatcggtggatcccgcaggcaggcgctcttccgtgattcgagatgttcgcggctttatcgttgaaaccattgaccctgtcggtaatgtgaccaaggtggaatattccccagaaggatgggccacaaagattattaacccggatgggagtgaacggtctgcttcctatgacggggaaggtaaccagattacggctactaacgaagcaggcgtgacgactacagcaaaatatacagtgtttgataaggttagtgagattgttgctgctgatggtggggtgactcggtacacgtacaacacacagatggagcccatcacggtgacgaatgcggatgggcatgcatggcggtttgaatatgattgggacggggaggtcatcaaagagaccgattataacggtcttgtgactgagacccgcaggtcacgggatggtttgcgtgcagacattattaatggggaaggaatcgttactacccattatgatgctttcggccgtttaaccgaagtacatgagattgatgatgtggtgcggtttacccgagacaagttgggggagattacccaggtgtcaaataagtggtcaaccgttgattatcagcatgatgagtatgggcggaccatttcagaaacaacaaccctatattccggggaacagacaacgattaacctgtcccataatccgaatggcgtcattgattcggtttcgcatgtgctgcctgatgagcgggtaatttccgagaaaacccggtttagtgaggggggagatgtatgcgaactagcatattctctcgatggtaaagaggtagcggttgccggattaggcgttgatgctcttggccgcaggtcgtggattactgtggattccacagttcgcaagctcaagtttgataagcgaagccgggttgtctcggaaaccatggtgaagctcggcggggaagccgcgacaacaagcatcgttgatcgggcgttttcgtggcgtgtggatgatgtgttggaacaggtaaaagacgcagttcgggataccacaacagattatgtggtggattctttggggcggattaccagtgtgacgcatgtggatgctgcgcgggatcagaaaccatcggagtcgtatgggtttagtcgggctggtatgttgacgaaacttcatcctgatacttctgctaagtgggctgatgatgtggatttgtatggtggtacgatgccgcggcaaatcggtcggactacgtttacttatgataaggctggtcgtgtgacgcagacggtgacgaagcggttgtcgaagaagccgttggtgaagcatttctattatggttccggcacccagccagtaggttatgaggattcggatcaccctggtgttggttggcggtatttgtatgatggcctggaccgtcgggttggtaaggaacagattgatactgttacgggggatgtgctgagccgtacggtgtttatgcatcaggggaaccggcttttcggcgagcaacgcacagtgaatgcgcatgaaccgcgtttggtgggctcaggcaagttgtggcctgttgactcatggactggtgatgtaatgggccagattgagattgctgcttcgagtggccctgttgatggttggtcgcaggatcaggtggatgcggtgttttacgcgatgatcagtgattttgctggtgcgccgagggagcttgtcgacgttactactggtgggattgttggttatagtaagcaatcactgttcgggaaacgcacttggtttggtgagaagtcttcgccattgttgtttgctggccagtatgaggatgctgagtcggggtgggtgtataaccggttccggtactataatgctgcgtttggcatgtataacgcacaggatccgttgggtgttggaccgaatttggctagcgcgcaagcgtatgtggataatcctactacctgggtcgatgtttatggtttaagccactcgcaaccgagtaaaaaagctcaacaacttgcgcagaaccgggcgcaagggaagaaagctgaggctgatgttcgcaaagtcatgcaggaagaacttgatgcagccaataaagcggatccagctggtgccggaaagcgaggtattggcgaacaagttgcaatgaagacatcagatggcagccctactcgcccagatttcacaataactaacgggcagaatcaatataaggtgtttgaggttaagagcggaaacgctggtctctctaatggtcaaacagctatgcagcgggatctcagtagcggtaagcctgtggaggtccgtgctacctcccgcggtgaaggtattggtctttcccaaggagataagttcacaggtacttatagcgtagtgcggcctgatcaacccggggcgcttaataacctgcgccaaacattgcagcaattctggagccccccggccaaatag

SEQ ID NO: 110 - DNA, 6177 bp, Desulfatibacillum alkenivorans
atgtccatcggttctggtgtgagaataaggttcggctattttgcaattattgcactaattgtattcatggcgcccgcaacaggatgggcggtgttttcggaaaccttcaccgaaaccagcaccttttccgacaaattcatccagaccggcgcatccagctattccgtacccttggaagttcctccgggcaggcagggcatggcccccaacctggagttgatatacagcagcgcccgtcccaacggatgggtgggcgtaggctgggttttggatatgggggcgattcaacggaacacccgcctgggcttggactatacagccgacgactacgtattcaccaagaacgcccgcaccaccgagctcgtgagccgctccacggactggggcgccgacatgtacggcgccaagatagaaagcaaatttaccaaatatgaattcaaggctggcagcggcgattactgggtcgcaaccacccgtgacggcgacaagtactattttggacaaacaatagcatccagaatcgaaaacgccaacggagacattttcaagtggtgtctggacagggtggaagattccaacggcaactatatgaccatttcctacaccaaggatcagaaccaaatttatttagacgagatagaatacgcaggtcatacatcaggcgtggccgcaaccaattcggtcaagttttatctggaagatacgcgaacggacgacgcccccatgtaccagtcccacatggaggttattacggcctaccgtttgaaatccgtggaaatgatcgccaacaactccactgttcgagcatactcctttaattataatcagcccacgttaagcaagcgttcctggcttaccagcatccaaaaatacggtgacgacgccgttcttgatgttgacggagacatcacttccggtacgtcatttcctcccgtttccatgagctaccagacttgcgcactcggaggatcggaagagtgttggggaaagcatgacagcctgtatcttcctgcaggccgctacggcggcgggtatgcggattggaacggagacggaacaacagaaatcattttcataacaaattctttgatgacatacttggttcccactgaaagcccctatcctccaaacggtttcgcccaggaacataatatattaagtagtgctaatatctcctatccaggttttgctatcaacaccaccgaaacgtttatgggcggcttcggcgatttcaacggagacggaaaagccgactacgtgtacaacaggcttaccaatacgcttcaggaaggcgacgacattgccgtagttttgtccacaggaacgggtggtagtttttctgtatggggcgccaaatcccaggacattgaaccggacgattatggcattggcgattttaatggggacggctttgacgacctcatgtatcgccaggatcgtgacgacggagacaacatgtacgttctggtttccaatggagaagacgccttcacagaatcattatggagcacccaggccctgtctcatacgtatggtccaaatggagtaggcgacttcaacggagacggaaaatccgattggtgcttcgtcaactccgtaggcatgtttttggtcaaattatccaatggctccggcttcgaagcccaatccgtctgggcggatcgaggggtgggctattttgttaagatccaggaatatggtttcggcgattttaatggagatggattgaccgactattgctggggcgagaatgatgttcaatggactgcttggaatgactatgaaaacggctctacccaaactatgcctgaagaaacctattatgtcgccttatccacaggcagcggatttgacattcaacaatgggctaccttcaaccatggcactgacgtctacggcactgacggctacatgtctttttccgggcttggggatttcaatggagacggaaggaccgatctatctttcgccaattccgagggcggcgtgcatatgatgttttccaggggagactcttttgagcattattcctggacaggtttttcccatgatttggccagcggcgagattcaaacgactgccagttatcaacgttatgcaagttctctaactccccggaccaccgaatatggcattaatccgtttgagcagtttaccgagggctggcccgcgccaaccgctctggctggtctgggcgattttgacggggacggcaaaaccgactttatctatagctttgaacaagacgccgttacaatggatttctttggaggatccatcatcatagagcccgccatccctccaacttattatgtcctgacaactaacgccggcattcccgaccttctcaccgaagtggacaacggcctgggcgcaacagtggaatacgaatacaccccgtccagcgaatgggataacgactatctaccctttttgatgcaaaacctgacttccgtcacggtagatgacggcctgggcaatacatccaccacggagctttcctattccggcggtctgtacgatcccgtagagcgggagttccggggatttgaaaccgtcgccataaccaacccggacgccacggtttccgtcacggattacgagcaggaggatgatttcctcaagggcaggccccttacccatgagtttcattccgcaactccgggaaccaacaccctcaagctctccacaacctatacctgggcctctgacactattacttgggaatccgacgccattacgccggaatccaaattcgtctacctaacttccaaagaaacggatgttttcgacatcataggcggagtatccaccacagcctcggagaaaaacatctcctatgcccacgactcggacaccggcctgacggaatacgaaatcgtgaccggctcggactacgaaaccgggacaggcccctccatcaagaccgcgtatgaatacagccagccggccggggtaacggaatggctctggcggttggaggaggaagccgtttacgactactccacgctcactgttaaggcgcagaccgattactcgcatgacgtctacggcaacgtgacggacgtggagtactggctggacggagggacctccccgtccgtgtcctacacctacgacgcctacggcaaccagttgactttcacggacgccattaccaacacctggaccaccacctacgacgccgtggcccacgcctatccggtcacgactcaaaacccgctgggccatacaaccagcaagacctgggatcaaggcttcggggctcccctcacgtccacggacgccaacaactacaccaccgcctttacctacgacgccttcggccgcctggagcagaccgacactcccgacggcggaaccacggaaatcgtgtacaccgacacaacctgtccgcgcacggtcctgacccgtgtgtatgacacggcgacttcctacatagcctccacggattatatcgacggcctgggccggaacatccagcatgtggaatccacggaaaacagcctgtacaccgtttcccaaactgaatacgacgaaatgggccgggtgatttatcaggtcgggcctttcttcaacggaaccaatacggcgtccatcacggcgcccacgacggatgtgcactatgtcagcacggagtacgactacttcggtagggccaccagcatagccacgcccaatacgagctccaccgtggcggtcacggagtttgattacgaaggccccaagaccacggttacgaacccggacgatggaataaccgaaaccatattggactacctgggccgaacccgggaaatcgtcgagcataatgattccagcctgtacacaaccgcctattcctatgacgtcttaggccagttgaccagcatcctggacgacaaaggcaataccatatccacggcctacgacaccctgggccgcaaaacccagatggtccatcccgacatgggaacttggacctattcctacgacgccaacggcaacctgacctcccagaccgacgccaaaagccaggtggtgaactttacctatgacagcctgaaccgcatcacccagaagtactatcccaacagcagtatgggaagcgttgattacatttacgatggttacctggggttaggaacggacagcgttggacgccttacttttgttcagaattcggaaagctactattggatcaaagattacgatcctatggggcgtattagctcggacggccgatgcgacaggtcacaacccatgtggtacgatttcagctatacctacgacctggctggccgccccacgtccacggaatacccggacggaatggaagtggattacacatacatacccggcacgagtttatggagccaggtgatttccggcacgcaggttttggccgagttttccggttatacggcccatgggaagtacgaactggtggattacgccaacggcgtgaccacggagcatacctacgacccggattccacgcggctcatggccatccagacatcctacggggcgaccgattaccagaactacgcctacacctatacggacggcggcaatatcgcctccatcaccgacaacatgcggagtcacgcatacacctacgcctacgacgatctgcaccggctgaccggcgaggcctccaccacgggctccatggcctggacctacgactccataggcaacatcctgaccaagtcccaggacggatcgtccatgacctacgcctacaacagcgtcacccacaagctggatacggtgacggcgggcggaaccgtatataactactcctacgacgccaacggcaatatcacggcgtgccccaagttagaaggggccggcagcatcagcgccaccctggccattgattataacgtggacaatatgcccgtccaggtggtgaaatccgtgtccggccagccggatgtgaccaccaatttctattacgacggaaacggcgcccgggtgcgcaaggaagtggtcggcgaaagcacgactttctatgcgggcagcctgtatgaagtcaaaaatggagtggcgaccaagtacatcttcggcgcggaccggcgcatcgccaagatcacggacggcgagggcattcagtatttttccaaggatcatctgggaagctccaccgtggtgacggacgaatccggcgccgtggtcgagcaggccgattaccggcccttcggcgaggaccgcttttacaccggttccgtagccacacccacgccctacaaatacacggaccaggaactggacgagtccacgggcctttacaattacgacgccaggcattatgatcccgccatcggccggttcatcagcccggattctttgatacccaatctatacgatccccaacagctcaacccctacgcctattgccggaataatcctcttatttatgtcgatcccagtgggcattacacagtcggcggagaagaaggccgcgattgcacaggcggagcccttaatggtggtggaggaataaaagggatcgggtctctgttaaactttgatcggtcttttggtgccttatgctatgggttaaagaccggtgaaatgcctcttgatgtagggtataggggagagcctggtggccgtctccgcggcaagttggtcgcaagcaattcaagtattgcagacatgattattcaaggtgttttaagtggtccatccccagccccagaagaagagcaagagccgctcaaacaaaatgatttgcccggctcatcagaagaagagttggatgctgaagcacttaaagacgctcttgtattctttgtggagtgtcaacaggacactatatattcagctataaatattggttttccaccgtctactccaataactgctgcgatgagagttaagcctacgtccagtaggccaccatcattgacaccgcctggtgcggggaggagaggcgcctttcggcaagcaaagagagattggggtatccctgtttcccaacaaccaaaaaagaccgggccaaatctggataaacgaggaaatgttaggccagggcgagcctatacttttgaagtaaaaggtaaaggtgggaagacaagaacaataactattcgtgatgatgctggtggggataactatggccctggaaacccacaaaatcgaggctctcatattaatggaaagaagggaacgcattatgactattga

SEQ ID NO: 111 - DNA, 4374 bp, Dickeya zeae
atgctcaacgatattctgagccgggtggcccgggtaggggccatgcatgccggaaaccgtcccaacccgcccgccgaccggccgcaaccctgtcagggtaaaccgccaacgtcgccgggcaagaccatcaagcacaagagcttcctgggtgcactggcgggtgccgtggccggggcgctggtggcggccgccgtatttaccgccgctgcggccgtggcgggtgctatcgccgttgcggcgattggcacgggtggaatgggggcggcgctggtggtgggggtggtaaaactggccgccggatttggtgcggtcagcctgctgggtgggctgatagacgcggtgtccagcaaggtgtcggcgatggtggacagcggctcgccatcgttcggaccggtgatggcgggctcgggtaacgtgtttgtcgaaaaacagccggtggcccgcgccacgaaagataccgtcgcctgcacccggcacaacagcccgcaactgattgcccagggcagcgagtcggtatttgtgaacgacgcgccagcggcccgtatcgacgataaaaccgtgtgtggtgccactatcaaggaaggggcctcgacggtatttttcggctccgggcagggcacctatctggagattgccgaagagtttaccgcgctgcaacgcgcgctgctgattgcggtggagtttctggtgccacccagccgcggcatgttcaaagggctggggaaactgttcacccgtgggccgatgtgggttctaaaagggatgcgtgtcggggcgctgaaaacgctaaaaggactgaaaagcgccgttaaatgtgccagtgaggggtttcgcaacaacaagggattgtcgcgtgtcacggaagcggtgcgcggtttcctcaaagacccggtttatatcgccagcggcgaggtgattgaatcccgtaccgatatcgcgctgggccagacgctgccgctggtgttcgaacgcacctaccgctctgcctcggtacacaccgggctgctgggccgcggctggcacgacagttggagcgaggtggcgacggtaacgcgcgacggcctcaacacccacgtggtcatcacgctggcacagggctacgacatcgattttaccttccatcaggacgtacaggcggtgtactgcccacactaccctgaatttaccctgcaccgccggggcgacggcttcagcctgtggcaccgcgaccagcagacctggcgcgactttagcgtggtgcagggcgagcgccggttgctgtcggccattcacgatagccacgacaaccgcatcgagctggtgcgcgacccgaaaggctacctgcgccaggtgcgccacagcgacggcgtcaccctgctgctggtgtggcggggcgaattcctgcaccagatacaacgtatcgatggcggccagaagacgttgctggccgggtaccgccaggacgaacagggccgactggtggaagcggacgccacccacgcctatcacctctattacgagtacgacgcggcccatcggctgacccgctggcacgataacgaccagacctgggcgcgctacgaatacgacgcacaggggcgctgcgtctacaccacctgcgccgacggttttctgaccgcccgcttcgactacctgcccgaccgggtggtgatgaccgacggcctcggccagcgcagcgaattcggctttaacgacctgcacctgatgagctgggaacaatccccgctcggccacgtcacccgctacgagtacgacgaggttggcaacctgctgcgggaaatctcgcccgccgggcgggtggtcgaattcggctatctggacgataccgggcgggtcagcacctttaccgacgccagcggccaccagtggcagtacgcctacgacgacgagcagcggctgtgcggcgtcaccgacccgctgggccgcgagtggggctgggcgtatgacgccgagggtaacccggaacggctgaccggcccggatgccagcgaggtccgattcacctggaaccgctatggcctgctgacccaggtcagcgacgccgccggtgaggtgcaggcgcggttacagtacgaccaccgtcagcggctgctgagtgccaccgacgccgagagccgcacccggcagttacgctacgacgggcaggaccgggtggtgcagtggcaacgggcggacggtgcccgtttccggctcggctaccgccgggccagctggacgctgccggagcagctgatacgcccggatgacaaggaagagcagcgccagtacgaccgccacaacaacctgctgagctacgtggacggcaacggcgcgctgtggcgtcagaccttcgggccgttcgacctgctgaccgcgcgcaccgacgccgaaggccgcacctggcactacgcgtacgataaagagagccagcaactgacgacggttattgccccggacggcagccgctggcagtggtggctggacgccgacgggcgggtcgtccgcgagcgtgacatgaccggcaccgagacccactacggctacgacgaggacggcctgtgcgtcagcgtgcgcaacggcgaaggcgacacccgccacttcctctacgacgcccgcgggctgctgttgcgtgaaaccgcgccggacgacaccctgcactaccggtacgatgcggtgggccgcctgaccgaggtctcgtcggccaccgcccatgtgcagctggactacgacctgcgcgaccgggtggtgcgtgaatggcacaacggcacgctgctcacccgccaggttgatgacgcggcccgcaccgtcacccgcaccctgacctgggacggcgatgcggacgacacgacaaacaccctcgcgccactcaccagtctgttccattacacccgcaccggcgagctgcggcaggtgcagttgccggacggtgccgacctgaccctgacccaggacgcggcaggccgggagtcgctccgcaccggcggcagcggctttgtccagcagcgggaatacgacgtgatgggctggctgacgcgggagatgagcggcgcgcaacacgacggccacctgcaaccagcgcagacgcgggaataccgctacgacggtgccggtaacctgaccggggtgcgtcacaaccgcgacgccgaaggttatcgtctggacgccaccggccgggtgcaggcagtgctgagcggcggggcgggcaaaccggtggacaccactgcccgttaccactacacccgcagcggtctgccgcaggaggcaggccgccttaccgagtggcaggccggcagactggtgcagcacgatgacacccactaccagtacgacagggccggacggcttatccgtaaacaggtactccagccgggctaccgcccgcaggtgtggcagtaccgctgggacagtcgcaaccagctgcgggtggtggataccccgaccggcgaacgctggctgtaccgctacgacccgttcggccgccgggtgggcaaacgctgcgaccagaaagccgaagagacccgctacctgtgggacggcgaccagatagcggaaatccgccactaccgccacggccagctgatacagcgccgccactgggtgtacaacggctgggagctggtggtacagcagcgccagcacaccggcggcgactgggaaacggattttgtgaccagcagccagaacggcgtgccgcaggcgctgttcacaccggacggcaccctgcgctggcaggccccgacagccacgctgtggggccagcggcaggcagaaaaatcggaaagtccggaccccggtctggccttcgccgggcagctccgtgacagcgaaagtgggttgtgctataaccgctttcggtactacgacccggctggcgggtgttatgtctcgccagacccactgagcatcctgggtggtgagcagaactatgcgtatgtgccgaatccggttggatgggttgatccgctggggttagctcgctgtaatgggttgccctcaactcgtaaaccgggtggtactggggcgagttatgattctataaatgggcaggggttgtatattttacatgaaggagggaaaataaaatatgtaggtcgcggagatgcaccttcgagattggatattcatgctcaaacccctggtaagtcacacctagagcaattaatcatttttgataacaatctgacaaaagcagaggcgaagtttttagaagaaaaattaataggtatgcatggtggcgcaaaatctatgaattcattgactaacctactaaataaaattcgatcatatagtccatctaatcctaatgcagcaaactataaagttgctggtgataattcattatggggaaatgaaatattaaaggatgcgctatctataataagggggaatacatga

SEQ ID NO: 112 - DNA, 4236 bp, Escherichia coli
atgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatccgctgctgggtgcaaaggtccttcccggtgaaaccgacatcgccctgcccggcccgctgccgttcattctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagagcttcgcctgagtccgcatcgttatctggcgacaaacagtccgcaggggccgtggtgggtactcggctggtgtgagcgggtgccggaagcggatgaggtgctgcctgcgccgctgccgccgtaccgggtactgaccgggctggtggaccgcttcgggcgcacacagacgttccaccacgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccgcgcggcgaactggcggcagtgtatgaccgcagcaatacacaggtgcgcagctttacttacgatgataaataccggggccggatggtggcgcaccgtcacacgggccgaccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggccggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaatccggccgtctgattcaggaaaccgcccctgacggcgatatcacccgctaccgttatgataatccacacagtgacttaccctgcgcaacggaagatgccaccggcagccggaaaaccatgacgtggagccgttacggtcagttgctgaccttcactgactgttccggttatgtaacccgctatgaccatgaccgttttggtcaggtgacggcggtgcaccgcgaggaaggcctgagccagtaccacgcatacgacagccgtggacagttaactgcggtgaaagacacgcagggccatgaaacgcggtatgaatacaacgccgccggtgacctgaccgccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaatggcgaaaccgcagagcagtggcagtatgacgaacgtggctggctgacagacatcagccatatcagcaaagggcaccgggtgacggtgcattacgggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgccgcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaaccttgatatccgcatcccgtatgccacagacccggcaggtaaccgcctgcccgacccggagctgcacccggacagcaccctcagcatgtggccggataaccgtatcgcccgtgacgcgcactatctttaccggtatgaccgttacggcaggctgacggagaaaaccgacctcatcccggaagggggtatccgtacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccggctgaccacgatacagaacgacaggagccgcatccagacgatttatcagccggggagcttcacaccactcatcagagttgaaactgccaccggtgaactggccagaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgaatgaagagaacccgcatcagctgcagcagcttatccggctgccggggcagcagtatgatgaggagtccggcctgtattacaaccgccaccgctattatgacccgctgcaggggcgatatatcactcaggatccgattggactgaaggggggatggaacctgtatggatatcaattgaatccgatatcagacatcgaccccctgggtttatctatgtgggaggatgcaaaatcgggggcatgtactaatggtctttgcggcacactatccgctatgataggtccagataaatttgattctatagatagcaccgcatatgacgccttaaataaaataaatagccaatctatttgcgaagataaagagttcgctggtttaatatgtaaggataatagtggcagatatttctcaacagcacctaaccgaggagaaagaaaaggatcatatccattcaatagcccttgccctaatggtactgagaaagtatcagcttatcatactcatggtgcagatagtcatggagaatattgggacgaaatattttcaggtaaagatgagaaaatagttaaaagtaaagataacaatatcaagtcattttatttaggtacgcccagtggtaattttaaagcaatagataaccacgggaaggaaataacaaacagaaaaggattacctaatgtctgcagagttcatggtaatatgtaa

SEQ ID NO: 113 - DNA, 4263 bp, Escherichia coli
atgagcggaaaaccggcggcgcggcagggcgacatgacccgcaagggactggatattgtgcagggttcagcaggggtgctgataggcgcgccgacgggggttgcctgctcggtgtgtcctaaaaaaaaggacagtccaaattatggcaacccggtgaacccggtgctgggtgcaaaggtgctgccgggcgagacggacattgcgctgcccggcccgctgccgtttattctttcccgcgcctacagcagctaccggaccagaacacccgcgccggtgggggtgtttggtcccggctggaaagcgcccttcgatatccgcttacagatacgcgatgaaggcctgatactcaacgacagcggcggcaggagcattcactttgagccgctgtttcccggcgagataagctacagccgcagcgagtcactctggctggcgcggggcggagtagcggcgcagcacagttcgcagccgctaagcgcgctctggcaggtgctgccggaagatgttcgcctgagtccgcatgtgtacctggcgacaaacagccttcaggggccgtggtggatactcagctggccggagcgggtgccgggggcggacgaggtgctgccgccggagccgcccgcataccgggtgctgacgggcgtggtggacggcttcgggcggacgctggcctttcaccgggcggcggaaggtgatgtggcgggcgcggtgacgggggtgacggacggcgcgggccgccgttttcacctggtgctgaacacacaggcacagcgggcggaagtattccgtaaacagcgcgccacgtctttatcttcccctgccggtccccgttctgcttcctcttctctggttttccccgacacgctgcccgccggtacaggatacggcacggataacggtatccggctggaggcggtatggctgacacacgacccggcatacccggatgaacagccgactgcgccgctggcgcgctacacgtacacggccggtggtgaactgcgggcggtgtatgaccgcagcggaacgcaggtgcgcgggtttacttatgatgcggagcacgccgggcggatggtggcgcaccattatgcggggaggccggagagctgctaccggtatgatgataccggtcgggtgacggagcaggtcaacccggaggggctggactaccgctttgagtacggagagagccgggtaatcatcacggacagcctgaaccggcgggaggtgctgtacacggaaggcgagggtggcctgaagcgggtggtgaagaaggaacatgcggacgggagcattacccgcagcgagtatgatgaggcggggaggctgaaggcacagacggatgcggcggggcggcggacggagtacagcctgcatatggcgtcgggtgcggtgacggcggtgacggggccggacggcaggacggtacggtatggctataacagccagcggcaggtgacgtcggtgacgtacccggacgggcttcgcagcagccgggagtatgatgagaagggaaggctgacggcggagacctcgcgcagcggtgagacaacgcggtacagctatgatgacccggcgagtgagctgccgacagggatacaggacgcgacgggcagtacaaaacagatggcatggagccgttacggtcaactgctggccttcacggactgctcggggtacacgacgcggtatgagtacgaccggtacggtcaacaaatcgccgttcaccgggaggaaggcatcagcacttacagcagttataacccgcgtgggcaactggtcagtcagaaggatgcgcaggggcgggagacccgttatgagtacagtgccgcaggcgacctgacagcgacgatatcaccggacggtaaacgcagcaccatcgaatatgataaacgcgggcgtccggtgagtgtgacggaaggcggactgacgcgcagcatggggtatgacgccgccgggcgcatcaccacgctgactaatgagaacggcagccagtccacgttcctgtatgacccggtggacaggctgacggagcagcgcggctttgatggcaggacgcaacgttaccagtatgacctgaccggaaaactcacgcagagtgaagacgagggacttatcaccctctggcactacgatgcgtcggaccgcatcacgcaccggacggtgaacggcgacccggcggagcagtggcagtatgatgagcacgggtggttaaccaccatcagccataccagtgaaggccaccgcgtggcggtccactacggctatgacgataaaggccgcctgacgggcgaacggcagacggtggagaacccggagacgggggagatactgtgggagcatgagacggggcatgcatacagcgaacaggggctggcgacccgtcaggagccggacggcctgccgccggtggagtggctgacgtatggcagcggttatcttgcggggatgaagctgggcggaacgccgctggtcgagtacacgcgggaccggctgcaccgcgagacggcccgtagcttcggcggggcgggcagtacagcggggtacgaacaggccacggcgtacaccctcacagggcagctacagagcaggcacctgaaccttccgcagcttgactgtgactatacgtggaacgataacggacaactggtgcgcatcagcggcccgcaggagtgccgggagtaccgttacagcggcacgggaaggctgacgggcgtccacactacggcagcgaacctggatatcgatatcccgtatgcgacggacccggcaggaaaccggctgccggacccggaactgcacccggacagcaccctcacggcgtggccggataaccgcatcgcggaagatgcgcactatgtctaccgctacgatgaatacggcaggctggcggagaagacggaccgcatcccggaaggggtgatacggatgcacgacgagcggacccaccactaccactacgacagccagcaccgtctggtgttctacacgcggatacagcacggtgagccgcaggtggagagccgctacctctatgacccgctgggccgccggacgggaaaacgggtgtggcggcgggagcgtgacctgacggggtggatgtcgctgtcgcgtaaaccggaggagacctggtacgggtgggacggtgacaggctgaccactgtacagacccaacagacaagaatccagacggtataccagccgggaagcttcacgccgctcctgagaatcgaaacagagaatggtgaacatgcgaaggcgcggcaccgtatcctggcggaagtgttgcaggaggacacgggtgtgacgctaccggcggagctggcggtgatgctggggaggctggagcgggaactgcggcagggcatcgtgagtgaagaaagccagcagtggcttgcgcagtgcgggctgacggcggaacagatggccgcgcaactggaggcggaatacatcccggagaggaaacttcatctttaccactgtgaccaccgtgggctgccgctggcgcttatcagcccggaaggggaaacggcgtggcagggggagtatgacgagtggggaaacctgctgggcgaggaaagcgcgcagcaccttcagcagtcactccgtctgccgggacagcagtatgatgaggagtcggggctgtactacaaccgcaaccggtactatgatccattgcaggggagatatatcacccaggacccgatagggctgagaggtgaatggaatctgtataaatatccattaaaccctgttcggtttatagattctttgggtttaaaattccatgttaacggtgatccaagtgattttaatcaggctgttgagtatttaaaacaagattcacaaatgaaagaaactatagattttttatcaagctctgaagaaactataaatatagagtatattgaaggaaccaatgttagatttaattcgaataatatggcgatatattggaatagtagagcatctttattttgttcaactgaattaaactcgaaatcacaatcgcctgcattaggtttgggacatgagtttgctcatgcgcagtattaccttcttgataagaaaaatttcatggctcttttaagccgaacagataagaaatatgagaataaagaagaggcaagggttattacaataattgaatcgcgtgcggcgaaaactttaggtgagtgtaccagaggagctcatagtggactgcctttttatcgggtggatggaccgttgcagacgatgaaaataacgggtacgccagaatag

SEQ ID NO: 114 - DNA, 4278 bp, Escherichia coli
atgagcggaaaaccggcagcgcgtcagggcgacatgacgcagtatggcggtagcattgtccagggttcagccggggtgcgcattggtgcccccaccggcgtggcctgttcggtgtgccccggcggggtgacgtccggccatccggtcaatccgctgctgggtgcaaaggtccttcccggtgaaaccgacatcgccctgcccgccccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactctggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgtcgggttacaccgaatatggccgggacaacggcatccgtctgtctgccgtgtggctgacgcacgacccggaatacccggagaatttacctgccgcgccgctggtgcgctatggctggacgccgcgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagcccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacggcctgaccggcaaacttatccgcagcgaggatgaggggctggtcacccactggcactatgacgaagcagaccgcctcacgcaccgcaccgtgaagggtgaaaccgcagagcgctggcagtatgacgaacgcggctggctgacagacatcagccatatcagcgaagggcaccgggtgacggtgcattacgggtatgatgagaaaggccggctgaccggtgagcgtcagacggtgcatcacccgcagacggaagcactgctctggcagcatgagaccagacacgcttacaacgcgcaggggctggcgaaccgctgtataccggacagcctgcccgccgtggaatggctgacctatggcagcggctggctggcaggcatgaagctcggcgacacaccgctggtggatttcacccgcgaccgcctgcaccggaaaacgctgcgcagattcggccgttatgaactcaccaccgcttatacccctgccgggcagttacagagccagcacctgaacagcctgcagtatgaccgcgattacacctggaacgacaacggcgaactcatccgcatcagcagcccgcgccagacccggagttacagctacagcgactccggcaggctgaccggcgttcacaccaccgcagcgaatctggatatccgcatcccgtatgccacggacccggcaggtaaccgcctgcccgacccggagctgcacccggacagcaccctcagcatgtggccggataaccgtatcgcccgtgacgcgcactatctttaccggtatgaccgtcacggcagactgacagagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccggctgaccacgatacagaacgacaggagccgcatccagacgatttatcagccggggagcttcacgccactcatcagggtcgaaactgccaccggtgagctggcgaaaacgcagcgccgcagcctggcggatgcccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcgcttatcagtgcggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattggactgaaggggggatggaatttttatcagtatccgttgaatccggttcagtatatagaccctttgggattagatctattatcattaccttctcccagacaaaaacctgtaagtcaatcctgtactattgatcctataactcaacaacctgttggtaggtttataggtgattctaaaggcaatattatggttgaaccggtaggtggcagaacaatcccgtatccccccagtaatccaggaagtgcagatactcacactctttatcagaataattcaaatgcttataggcttaatccaatagggcatgcaaacaattcaacaccacatgcacatgcacatttaccaggaacaggtagcggtatgaaaggccaaggtccatcccttgatgttaatggtcgcgttgtaccatggaatagtagtgccgcacatatcggtattagatcactcggtacactaagcttttttagttctgttttacatatgtttacacttagatcatgtaaagagggaacgtttggacaatgttattgtgctatgtatgttgaaatgtcaacgggaagcaatcaagatgaggctgatataatgtgcggaatgcctgagtatttttag

SEQ ID NO: 115 - DNA, 4647 bp, Datisca glomerata
gtgagtgactgggacgtcctggagctggacggtgatccgaccccgggcgacccagaagcggtgcgggccctggccacccggctacgggagcaggccgagcgagccgagagctccaccacccgcctgcgtgcgatcgcggccaacggcggtgatctgcggatggccggtgactacgccccccggttcaccgaggcgctcgccgaactgcccgacgagctggccaagctcgcccgtgcctaccacggctgcggcgatgcgctgtccacctatgcgacgactctgaccgaggcgaagacacgcgcgggtggcgcgctgcggcagggcctggacgctcacggccgctaccaggcggcgttgcgtcaggtccggacgctgctgccgcccgaccgggaggtggcgttgtggccgcgggccgagctcagcgacggctcgatcagttccgcgacggtgggctgggagtcccccgatcttgccgcgcaggtgcgggcggccgcgcagcaggggcaggtggccagcgccgaccggctgcgggcccggcggctggccgacgacgccgccgagttgcgcgggaacgcggcgcacacctgcgcccgcgagatcgaggacgcgctggccggcagcgggatcaagaacaagccgtggtacgagaaggtgtggaacgccgtgtccgcgccgttccggtcctgggacagcttcgtggagctgtgtcgtgacgtcgccatggtcgccggtgtggtcgcgttgttcgtctccgggccgatcgggctcgcgctcgtcggcatcgccctggtggccggcgccaccgtctttgccagcacgctggcgaagtacgcgcgtggccaggcgtcgttgggccagctcggtctggacgcccttggtctcatcccgggcgcgcggggcgttaccagtgccgccgggctggcacgtgccgccgctggtctggcgcgtggggtcacgcacggccaaggggtgaagctcgtcggcgccgcgctgcgcggcgccggcacggcgctggccacccgtgggcgcaacatgatgtcggtagccaggtgggggctttccaacccgcgggcgaacggggtcgaggccgtcaagcgcctggtccggctggacccgatcgacgtcgcgaccggtgacatggtgctgacccagaccgacgcggagctgcccggcgtgctgccgttgccgctgtcccggacgcacgtctcctcctatcggctgggcagctggttcggccgttcgtgggcgtccaccctcgaccagcggatcgaggtggacgacaacggggtctatttcgccaccgcggacggcatgaccctggtgtacgcggcggtctcggacgccgacgggccggtgctgccggtggaggggccgcgctggcccctgacccgcggcgcggacgggacatacgcgatcagcgatccgtggcaggggcggacctggcatttcaccccgctcaccccgctcaccccgccgcacggggcagccggcgagccgcgaccgtccggtgggcagcgggcggccggcggacccgtccagtggccgctgagcgcgttgaccgaccgcaacggcaaccgcattgatttcgtttacgacggggatgacgctcccgtcgagatcgcccattccggcggttaccggatccgggtggacacctggcgacaccgggtcgtcgcgctggccctgctcggtgacggcggcaacgaccccggcggcaacgatcccggcggcaacgatcccgacgggtccgcgaccgtgctggtgcggttcggctacaccgaggccggtgaccttgccgaggtcgtcaactcctcgggccagccgctgcactacgactacgacgacgacggtcgcatagtgcgctggacggaccgcaacgccaccgaataccggtatgcctacgacgcctccggccggtgtgtggccacggtgggcagcggcggctgcctgaccggccagctacggtacgacaccgagcggcgcacgaccaccgtcgtcgactcgctgggccacgcgacgatctaccatcgcaacgaggcgctgcaggtcgagtcggtcaccgacccgctcggcaacatcagccgttacacctgggacaggtacgaccgcaagctcaccgagaccgacccgctgggccgtaccgtccgctgcacctacgacgccgccggcaacctggcggagatcgccaggccggatggtggtcgaacaaccgcgcggtggaacgatctgcggctgccggtgaccctcgtggaaccggacggcgaccgctgggaacgctcctacgacgaccgcggcaacctgaccgccgtggtcgacccggccggtgcccggacgctgctcgcctacgacgaccgcggccggctcacggccgtcaccgacgcgctcgggcacacccggcgggtcgagaccgacgccgccggcctgcccgtcgcggtgaccgacccgctcggcgcggtcaccgcctacgagcgggacgccttcggccgagtggtcgcggtgaccggcccgatcggtgagatggcccggttcggctggacggtcgaaggcaggctggcctggcacacccggccggacggggccaccgaacgctggacctacgacggggagggcaatctcgtcgagcacgtggacgcggccgggctggtgacccgcaccgaggtcacgcatttcgacctgccggcggcgcggaccggcccggacggggcgcggctggagttctcctacgacaccgagctgcggctggtcgcggtcaccaacccgcagggcctggtctggcggtacgactacgatccggcggggaacctcgcccgggagaccgacttcaacgggcgggcgctggcctacgggtatgacgccgccggccagctcgtcgaacgcaccaacggcgccgggcagaccgtgcgcttcacccgcgacccgctcggtaacgtgatcgagaagcacagcgcgagcggtgtgacgacgttcacctacgacgcggcgggacgggtgacacgggcgacgaaccccgacgccgactgcgtgttccagcgggacgccctcggccgcgtgctggccgagacctgcaacggccgtacgctcacctcggcctatgacgtgctcggccggcgggtacggagggtgaccccgtccggggcggccagcgtctgggagtacggcccgaacgacctgccgctgtccctgcgcatcgccggtcggaccctgcgtttcacccacgacgaagccggccgggaggtacggcgcagcctggacaccggtgtcgtgctggcgcaggcctgggacgtcaacgaccaactgttgtcgcagaccgtgaccgcgggcgggccggggaccgcgcgacaggcacggctgctccagcgccgcgactacagctacagtccggacggctacgtcaccgagatcgacgacatgctcgccggcctgcgccggttcgacctcgacccggctcggcgggtcaccgccgtccacggggcgaactggtccgagcgctacgcctacgacaccgcgggcaacatcaccgacgcgtcctggccggtgcccacacagcgcgacgggcgcgacggggagcacgaggccgcgcagggcggacgtgagtacaccggcacactgatccgccgcgcgggtagcgtccgttacgagcacgacggccagggacgggtgaccctgcgccagcacaagcgactgtcggcgaagccgcgtacctggcgttacacctgggacgccgacgaccgcctgaccgccgtgaccacccccgacagccagcgctggcgctacctgtacgacccgttcggccggcgtatcgccaagcagcgtgccgccgacagcggcaccggtgatgctggtggggtggccgagcgggtcgacttcacctgggacggcgccgtactcgccgagcagagccacgtcaccgcgggcgacccgacgggccgtatcaccacctgggactgggagcccggtagcttccgccctctcacccagtccgaacgccgcccatccgacggcgcggaccaggcatggttcgacgcccggttccacgccatcgtcaccgatctcgtcggcacccccaccgagctgatcggcccggacggcaacctcgcctggcgcaaccgaaccaccctctggggcgccagcccacagcccgccgacggcgccgtcgactgcccgctacgcttccccggccagtaccacgaccaggaaaccggcgcccactacaactacttccgctactacgaccccgaaaccgcccgctacgactccaacgacccgctcggcctggcccccgcccccaacccccacacctacgtccccaaccccctgggctggcttgaccccctgggacttgcgccatacgacgtcgccaggatgcggcactacaccaacgtcagaggtaaagaagggattctttcatcgggagtagtcagagccagcgatcagaacaaggtttttctggttccggccaagggcaagccgttgagtccccgtgacgcggaggagtatcttggtattgcgcgtgggcgtggtcggcacgtcttggagttcgatgttccagcggatcggttgagtaaagattacaaccccacaatgaatattcatgaatggaccgtaaccggggatatcgcggtcaccgacatcaaggtggtgcgctag

SEQ ID NO: 116 - DNA, 9951 bp, Frankia sp. EuI1c
atgaccggccggcaccgtcccgcttccagtcgccttctgtccttcgggcttctctcgttcggccggcgcaggtggcggcgtgacgcccgggtccgccgggtggcgccgctgctggcggtgctgctcgtggtcgtcggcctagtcgtgctggacgcgccggccaaaccgaaggcggtgccgatcgcggatcagaacccgttccgcggctcggacaagctgccgggttcgtcgtcgggtagcgcggcggggaaggtcagcctggtcccgacgagcgcgacgcagggcacggcgaaggcaggcccggcgacgctgaagggcaaggctcccgtggtagcgggggcagtggcgtcgacgggagcgacgatcacgccgctgaaacaggttccgttcaccccgcagaaaccgtcagcggatgaggcggcgagggcggcttccacgccgcggggcgcgcagctcgggccgtctcggcctcaggcggtgacgcggcctgacgcgagcggcgagatgaagccgcaggctggccgggtcgaggttccggggctgcggacggcgtcgtcggaggtgttccacaacccggacgggacctacacgtccgaggagtcgatgggcgcggaccggttcaaggattcgaaggggaactgggtcgggatcgacacgtcgctggtcgccggcgacaagggccggctgcgcgcgaagtcgacgcagtccggcctggaggtcgcgccgaaggcgaacgacgccgagctgggcagcatcgacctgggtggcggcctgtcgttcggtttcgggatcgcgcaggccgcgggggtggcggccaagatcgacgggtcgaaggcgacgttcgcgagtgttcgtgatcaggcggatgtcgagctggggccgaccgcggacggcatgaaggaagttcttgtgctgcgctcggcgcaggcgccgacgacgtgggtgtacccgctgacgctgtccggtctgaccgcgagactgagcgatggcggtgatgtcgagctggccgacaaggccggcacggtgcgggcgctgatcccgcacggttggatggccgactcgaggccgaccacagcggacggctttcaggcctggtcagatggcgtgacctacagcctgatcacgctggcgaacggtcagcaggcactgcagatggacctcgacaaggcctggctgaccgcgccggaccgcgtgttcccggtgaatgtcgacccgagcgtgtcgacgctgttgacgggagaggacgacacctacgtctcgtcggccaatccgtccgcgaactactccgcgctggcggacatcaaggccgggtactactcgccgaccaacgacatcgtgcatgggtacctgagtttcccaggcagtgacccgctgacgaacgcgacggtgacgaacgcgcacgtcaagattttcaactggttctccgccagcgggtgcacggcccacccggtgagcctgcggtcggtggcgttcggctggaacggcacgaacatgacctggccgggcgcgacgctcggcggtgaggtcgccaacaagtcgttcgccgatgacggcagctcgtcgtgcggcgggtcctgggagttcatcggggactacgacacccggctgagcaacttggtgaacacctggacccacgacccgactgccaacttcggcctcgggctgacgacgtcggacaccgacacccagtggctgaagtcgttctactccaacgactgctggtgcaacccggcgaccccggattcggactaccggccgcgcctcgagctggagtggacgccctacggcgcgtcctactcgttcccgtccgggacgccggcgtggtcggtgccgccgacgacgaccgctccggggcagatcacggtccggctgacgaacaccggccaggcgacgtggacggccggtgccggttatgcgctgtcgtaccacatcttcgatgcgacgaacacgttcgagttgattcaccagggcctgcagacgccgatcccgacgacggtggcgtcggaccagtccgtggacgtgaacgcgtcggtggatctgtccagtctgtcgtcgggtaactacacgatccgctgggacatggagcaaaccggcacctcctggttctccggccagggcgtcggcgagctcgccaccccggtgagcgtcgccgccggagtgaaccagtcgccctacatcgtcggggtctctccgatctccgggtccgaggttccctcgacgcagccgacgctgggtgtgctcgcgctcgacccggacaacgacccgctcacctaccagttccagctgtgtaccgggacggacgcgaactcgggcacctgccagtcctcaggctggacctcgtggccgatctggactccaccgacaccgttgacctggggacagctctattactggcgcgtccaggtctctgacggcacgtcgcaaagcctgtggtcgtcgccgctggtcctggagccggtgaactacaacgcgacggtcggtgctgactacggggcgaacacctacgcgcccgccgtcgccggggtcaatccgctcacgcagaacttcacgacccaggtcacggacgcgtcagtgcagggtgcgggtccggcgttgtcggtggcgcgtacctacaactcgaagagcacgaccgacggcctgttcggcaccggctggaccagcgcctacgacgtgaccgccggcgcggccacctccggtcccgggaacgtccaggtccgcaacggcgacggccgaacaaccctgttcggtcgcaacggcgacggtacctaccagccggaacacggctactattcgtcgcttcaggcgtccgaaccgcgggtggcatcgttcaccgccgcgaactcgaccagctccctgggcgcgacggacaccggcgagacctggcaggcactggccggcacgtggggcatctcgaacaactccgcttacctcgcgtccgccggaattttcaagtcggtggcggtcgtaccggcgcccgcggacggcacgatccagttctccaccccgacgacgcagtcgcggctcggcatcgcgttccgcgtccaggacgcggacaacatgtggatgctctacgagaacggaacgtcgctggtcctggcgaaacgctccggcggcctagagaccaccgtcaagacggtcacgggcgtctgctgcgcgacgacggacacctatggcgtccggatggtcggcagcaccctgcagatgctgcgcaacggcgctgtcgtcggcaccgcgaccgacaccgcgttctccaccgtgacgaaggccggcctgtacgcccagtcgaccggcaccggccggatcgacggcctgaccattacgcctgagggacatcgggcgacgttcaccggcgcgaacagcgccaccagcctcggggccagcgacgacggcgaggccttcaccggcctggccggcacctggggtatcagcggcaacagcgcctacctcgcgacggcgggcggctccgggcacaacctgaccactgtcagcggtgccgccgacggcacgatcaccttcaccgagcctgtcgcccaggccggggtcggcgtcgcgttccgcgctgctgacgtcgacaactactggcgcctggtcgcacagccagcgtcgaacagctggcagttggtcaaacgcgtcgcgggtgtcgacattgtggtcgcgacggcggccagtggctgctgtaccgcggccgacgtgctcagcatcatcacctccggcacgtcgatcgcagtgctgcgcaacggcacccagatcctctcaacccacgatccggccctgctgttcgccagccgcgcgggcccgtacgccgatgccgccggtaccggccggatcgacaccttcaccaccaccgccgccaccgagctcaccgagaagggcggcaccgcatccacgttccgctccgacggcaagctggtcgccaccaccgaccccgccggcaaccgggtcgccctcgcctacgacgccaactcccggctcaccacagccacgaacaccacgtccggccgggcgctgaccttcacctggaccaccgacaacacccacatcgcccaggtcgccacaccctcggtcgcggcgaacggcggggcactgacctggaagtacagctacacctccggccggctgaccggggtgaccacaccgggcctcacgactggcgggtcaacctacagctacagctcatccggccagctgaaccagatcacactgcccgagaacaccctcgacaccaaggtcggctacaactccgacggcaccgtcgcctggcgcgaggacggcctcggaaaccgcaccacctacgcggtgaccgcgaccagcccgaacatcgtcgtgcgcaccaccgacccggccggcaccaacaccgactggacctactcggtctacggacagctgctgtccaagacgggccctaccggcacgaagacgttcacctacaacgacgacgggttcctcgcccaggccaccgacgagaacggcaacgtcaccaactaccagaccgatggccacggcaacgtcctggcgcgcacggtcgtgcggtactccgacgcgtcgggcacctggccggtcaccgactactacgactactacaacggcccgcccggcgacccccgcgacgacctgatcgtcgcccaccgcgacggccgctccgccgcaccgaccgacgatgcctacaagacgacctacggctacgaccccgtcgggaatctgctctcgacgaccagcccgccgaccgccgcgttccccggcggcaccacaaccagctccagctacaccgtcggcgccgagaccgccgtcggcggaggaacagaacccgcgggcctgctcgcctcgacgacggatgcccgcgggaaggtcacgacctacggctacgactccaagggcgacctgcgccacgaccaggaccccgccggcctgatccacgactacacgaccgacgagatcggccgccggctcacgtccaaggaaacctcggacacctacccctccgggctgacgacgacctacacctacacgaagctctcccaggtcgcgaccgtcaccgaacccggcgtggccaacccgatcaccagcacgacccacacccgggtcacgacgaacacctacgacaacaacggcaacctcacccaggccgtcgtctccgactccaccggcggcgacaccgcccgcaccaccacctacacctacgacgccgacgaccggccgctatccaccaccgccgcctccggcaccgcggccgccgcgaccaacgcgcagacctacgacgccaacggcaacgtcgcgacgacgaccgacccgaacggcaccgtcacggcctatacctacaccccgctcaacgagctcgcgacgacaacgctgaaggacttcgtcgacgacccggtcgcgggcacgtcaccccgggacctggtcctcgagtcgcgggcctacgaccccgccgggcggctcgcatccgtcaccgacgcgctcgggcgcacgaccaactacacctactggctcgacggcaagctccaccaggtcaccctcaccggctaccacaaccccgacttcgccaccggcgacctgtccgccacgacacggaacatcgtcctcgaagaccactcctacgacggcgccggcaacgagaccagcaccgtcaccggcggcgggctgaccaccgccaccgccagctacgaccaggccggcaacgcgaccggcaccgcgctcgacccggctggcgtccaccgcaccacggcgctgtcctacgacgcgaacggcgaccccaccgcgatcgagaccggcgccgccggcacgtcgacgaccgaacgcaccgagtacggctacgacaacgcctcccgactcacctcgacgaccgtcttcggcgacggcgtcgcccgctacaccaccgcgctaacccgcgaccagcgcggctatacgacgacgctcgtcgacccgcgcggctacaccccgggcgccgcgttcgacccggccttcacgacccatgtcacgaccaacgcggccggcggggtcggccaggtgaccgccccgtcggtacaggtcgaggagaacggcaacacggccagcgccgcgaccccgacggggacggtcggctacgacacgttcggcgaggtcacccagagccgcgacgcccgcaacctgaccacaaccacgacctacgacgcgctcggccggcccacccaggtcagctacccgtcgtacacgccacccggcgggtccgcgtcgactccgtccgagtcgttcacctacgacgacaacggcaacgtcctcacccacgtcgacacccgcggccagacgacgaccgccgtctacgacatgcgcaaccgggtcgtctccgtcacggatccgcaggtcgacgggctgccggcccccggagtaagtcgcgcgatctacgacgacgcgaacaacctggtcacgaccgtcgaccaggtcggtgcctggttgttctacgcctacgacgacctcgaccgcccttgggcgacgaccagcaccgaacgcaccccgagtgccaccttctccacctactacggctatgacgacgccggcgacctcaacaagatcctccgcccgacgaacgtcggcgccggggccgccgcgacggccgactacaacggtgccggcgagctcatcgccacccacgacgaggcaggcaagaccaccacctacacctacgacctcgccggccggctcgcctcgggcaccgacccgctcggccgcaagacgacctacacctacgaccgggccggccgccagacaggcgccgcccagttctcgaacaccaacgcccagctgcgaagcctgtccatcggctacgacgcggcgggcaacgtcacctcccagaccgacccgaacggcaacaccaccaccgacgcctacgacgccctcgaccagctccgctcgatcacggtccccgtcgcggccggcagttcgatcacgacgtcggcgggttacgacaccgccgggaaccgcacccggctgaccgacggcaacggcaacgccacgatcaccacgttcaacagccttggcctgcctgagaagacgatcgagccatcgaccaccgcctacccgaacctcaccgaccgcacctggaccacctcctacgacaccggcggcctgccggtcaccgaggtcgagcccggcggtgtcacccgcacctccacctacaacgcactcggccagctaatcggcgagtccggcaccgggacgggcgtggcctcggcgtcccggaccctggcctacgacctggccgggaacctgaccaacgaggactcgccgtccgcctccgaggagttctcctacgacgaccgcgacctgcacaccggctcccacggcaccgaaggcgacgcatcactccagtacaacgccgacggcctgctgacctcacgcggcaacggtggcctcaccactgggtacacctacgacacccgcggcaacctcgccaccgtcaccggcgccggcacccccgggacccggacctacagctatgacgacgccgaccagctgacctcgatcgactacgccacgggcagcagcggcgcggtcgagagctacggctacgaccagctcggccgcaccacctccgacaccctcaccgcacccggcgggacgctgcgttcgcagacctacggctacgacaacaacgacaacctgaccgcgacgacgattgcgcccgccggagtcgccggcgccggctcccagtcctacggctacgaccaggccgaccggctgacgtcgtggaccagccaggcgggcagcactacggcctacggctgggacgctgccggtaaccggacgtcggttggtggcgtcaccgcgacgttcgacgcccgtaaccgcctgctgaacgatggcgccgccagctacacctacaccgcccgcggcactctcgcctcgaccaccgccggttccaacacgaccaccgacacgttcaacgccctcgaccaactcacctcggtggccagcgggtcgacgaccaccacctacgagtacgacgggctaggcagagcctcatggcgtaacagcagccaggccttcacctacgacgacctgaccaacgaacccgccttccacgacggcaccctctacgcctacgaccccaccggaaagctcatcggcgccgacaccggcagcgccggcctcgccaccctcaccaacccccacggcgacaccaccgcagccttcaccaccaccggcaccctcaccgacacccgcgcctacgaccccttcggcacccccaccaccaccggcaccagccacctcgaaatcggctaccaaggcggctggtcggaccccaccaccagccaactcaacgccgacacccgctggtacacccccaccaccggcaccttcaccgcccgcgactccaccccgctgccctggaccggcaccgccgccgacaaccgctacacctacgccgctgcgaacccgctgctcaacagcgaccccaccggccggcggtcgggtccctcctgggaaaccagggttttgagggctgccgccaccgaactcaggtcaggcgaggccgacgaagaagccggcgaagaaggcggtggagccacgagctacgccgtcagccgggaagctggctacggccttgcctgcgcggtcttctgcccacacaacgagccagacgcgaacgcgggcgccgcactcggcgccgcggtcggcacagccggtaatgacaacggggccaagctcggcgccgcgatcggttccgccgcgcagaccacgaccaagacgaagacgtcgaagtcgtcgcagtcggccagcagcacaccgacaaggaccaagacgtccaagtcatccaagccggcccgcagccccgcgagacagcaacccacctaccccgacccgaacgacgtcgtccacggcaccctgcacgtcaaccccgacgccaaccacggcgtcggcaacaacggcaccatccccaagccgaccgacgtgccccagacctactccaaccccctcgacgccaatctgggcccgtccactgacgagaccgcgggcctgcagtacaccgcctccgactccgactgccacaacgcgggcctcgcccactgcatcggcgacgatcccgtcaacccacccacccaaaccggcggcgcaggttcaggccagggcacgggccagggcggtgatggcacgccaccaccggacgaatacctcggcgatgagagccagaactcctgtgccgtcggtggacaaagtttcaccgcctccaccgaggtcctgatcgccgacggcaccaccaagccgatcagccagatccacccaggcgaccgggtccaggccaccgacccgaccaccggcaagaccgcccctcagaccgtcaccaacgtctgggtcaaccacgacaccgacctgctcgacctcaccatccaaaccgccactggcacctcgaccatccacaccaccgaacaccaccccatctggaacgacaccacccacacctggaccgacgccaacgagctccaccccggcgaccacctccacaccgacaacggcaccccagccaccgtcaccgccaccgtcgtcatccccgccagcggcgacatgtgggacctcaccatcgccaacacccacaccttctatgtcgtcactaccgggaccgatatcctcgtgcacaacgcatcctcgtgcacgagcggctccaatccggcagcgaggacaggacagcaagtccacaaggatttctcgaccatcttgaatggatatggggatgtcggctatgaaggcgagttcaagctccctagcggtcttcgaccggacggcgccttcacggaccctgcgaccggtgtgcgggtcccggtggaactgaaaccggacacccgaagccagatccgaagaggtctgggcgagctgagagtctacgagcaggaaatgggagtcccgtcgggctctggccagctttgggtataccgggtaaatccacaaacgggcgccgcgagcttccagagggttcggtga

SEQ ID NO: 117 - DNA, 6885 bp, Geobacter metallireducens
atggggggaaccaggtatctcattgtgggaatactgctcatggcggtattgagcctctgccgggcgtcattcgccgacacggtgacgtacggctatgacgatttcggacgccttaccgctatgaccactgtcgatgcgacgaggctcaccaggatcagctacctctacgacaacgtcggcaatttcacgaaccagaccgtaactgtggggattctcgtgaacatgccggacgccaacctcaggaatgccgtgtgcagcgcgctggggaagaatccttccgatccgctgaccagggatgacctggcactcctcaccaccttaagcgccgcgggaaaggggataagcgacctgaccggcctggagtgggcggttaacctgaccagcgccgacctgcgcaacaacaacatcacctcaaccgcgccgctggccggattgaccaagctgaccgtcctgcaactggacggcaaccccgttgccacgacagcggcagtgcccgccatgggcaccgtcggcctcgtgctggcaaccctcctgctgatgcttctcaccatgagccagcgattcaggctccccgggcgcttcatcgccctgctcgggctctgtttcagcctgtcggtcaccaccgtcaacgccgccgacggccccgccggtccggggtggctggaagtccagggcacaccggtgactccccaggaggcggacgcattctaccaagcaaagggcgtcatccagcccctctccgcaccgctcggttccattacgccgcaatcggccaccaccgccacccccgagatagccgcccttgcccgttccctcaagaatgacccgagactcatctacgaatacgtccgcaacaacgtcgactatgctccctacttcggctccctgaaaggggccacactcaccgccatagagggttccggcaacgacttcgaccaggcctccctcatgatctcgctgctgcgcgccagcggctacaccgcccagtacgtctacggcaccatgaccattcccgtcggcggcgaccccaaccagaaggatatgcagcactggctgggagtggatgccaccagcagcgtcatcggcaccgtcctggcgaacggcggcatcccctacagccagtcgggaacctccttcaccgtaaaccgcgtctgggcccaggccaccatcgccggcgccacctacctcttcgacccggccttcaagccccatcagaccatcaccggcattgacctgaagaccgccatggggtacagcaccagcggccttcttgcggcggccggcggcaccgtggggaccgattacgtccagagtctgaacgaagccggtctcaagagtgccctggacggctacaccctgaacctggccgcctacatccgggccaactaccccaacgccaaaacgtccgaaatcatcggcggcagtgccatcgtcccccagacccttgccgcgttcccgaccagcctcgacttcgccaccacggtcaccgccacttggaccgacatccctgacgcctacgtccacaaggtgagaatccagcacggcaagatcgaccagaccttgaacatccccgacctcgccggccagaagctctccatcgtctaccgcaccggttccataaccacggcttcggcagtggcggcgcccgcaacgactgagccgcaggtgaacctcgcgccgcttcctaccgccaccacccccgtcgacggtcagttgaccatcaccccggcgggtccgaccgacacaaccctgccgaacatcatcgtgccgggctcatacctggacgggagcaagacaatcgtccccatggccacggggtcggcaaatttcggctccatctatcccgcctcggcaggggcaagctccacctcgatgacgtgggggcccatcaccaaccccaattccgtgaccgtccagatagtcgtcacgctcacgagtaacccgcaaggggcatattccattacccagtacgccgggacaaacaatgtcgcccccggcgcaagcataagcccgaaggtggtcttctccaacgccggccagacggccggcaccaagaccggacagctccacatccaatggttctacaacgggacaccgattaccggcgccgactcttactacgacctcaccggctatgtcgccaacgccatgtccctcgggggctacggcctgaacgcccaggcgtacatgaacacgccgtacaccggcaacgcccggctcagcaacaacggctccctccccctggccgtcaccgccaagaccctcaccggcacaggcgcggcccgcttccagctcgtctccggcaccgccgccacaaccctggccgcaagcacctttcaggacatcccggtaacctatctggccgatgtccacggcacccaaacggcctccatcaacatgggcttcacctacgacggcatgacatacagcgccaccaactatctgcccttgcagggccaggccatctacaagcccgacttcaccggctcgctcgggttcaacgcgggcaccccctatctcgcctatccggtggacggcaccgcccaccttgccaacgccgggagccagcccctcaccgtgaccggcttcagcatcaccggcaccgatgccgcccggttcacgatcaccggcggcaacgcggcaggcaccatcgcctccggcggccaccgggacatcactatccgctatctggccaacagcgtcggcacccatagcgccaccctgcacatcacctatacgtacgacgggatcgccaactccatcgaccttaaccttgtcggccagaccctctccacaccggtggcccagctctggcttgacgacacgatgctggccgaggaactggaacctgtcaccggagttgacctcagcacgatgaccatctcagtcatgcaccagtatacgggcagcttcgccgaccagtcggtgaactacaccctgacgcgcggctccacctacgccatcgtctatgatttcggcggcagccgcctcgggaagctcctggagaaacgggagcggcagatgcaggcctaccgggaatcggggcttgccgacacctcccggcaggtgctcaccgaatccctcaacgtcatcggccagacctggatgcgggacaccaccctggacgccaaccttctcagccagatcggcggggtcatcgatctgcgccagcaccgcttcggcatcgtggcccaggaaaccggctactacatcgacgtgaaggcgcaggtgtccaccgtttcccccatccacggcgacaccattgcacgggatgcctacttcaggaccaccggccacctggccagcgccatggagcacggcgtgctggaacagatgcaggcgaacagcccggcggtatccacggtgaagcttctgcaactgaacaacgccgccgggaaaaaagccttcatggtcacctccgccaactacgccgccatcaagccgcagcttgccaactacagtacagatgatctgaacagcttccagaccagcgtcaccagcggcaacaccctcatcctcccggaaaacggcaagatccccctgcaagtctggtcgggcaaagggtacatcgatttcaacatggggggcacttcccggcacgtggggatgatcatcggcggggggtacaacggggggtacggggctatcaaggcgcctgtggcggttaatacagaaatggcccacgtgaatgtgaatctctcgccccaggccaccatcccgaaaataggcagcgttgatcccgttgacatggcgaccggcttctggatgtacagcaacaccgatcttaccctgtccggcggggcggggggcttgagcctcaggcgttcctacaacagcggcagcaacaacataaaggactcactcggttacggttggtcccataactatcatctttacgtggaaccccactcaagcacccccttcggcctcggccagcgccagcccgtggacgccgcggccctgatcgtcgcctcggtcgccaccctggatgtcatgaacggcacccctgacgtgaaatcatggctgacgggagcgctcatcggcaaatgggcaatggacaccctcaccaacaacgcggccggctgccacctggagactgacgtcctcaccttcgtgaagctgccggacggctcatttgcctcgcctcccggcgtcacctcaacgctggtgaaaaacggcagcctctaccaggtaaatgaacgcttcggccgcaccgtcacctttgacggcagcaacaacgccaacgccatgaccgacgccgacggcaatggggtcaccttcacctacaccggcgggaaactcagcaaggtaaccgacaatttcggccacagcctcgacttcacctataccggggatctcctcacctccgtgaccgacaaggcggggcgcagcgttgcctacggctacaccggcaccgacctcaccacctacaccgatccggaaggaaaggtctggacctatgggtatgacaccagccaccggattctgacactgaaaaacccccgcaccgtcaccaccgtcaccaacgtctacgatgcctttggccaggtacagagtcagaccatgcccaggcagaccggcaccgccacctacaacctctacttcaacggctaccgcaacatcgaggaggacggcaccggccaccagaccatctaccatttcgacgagcagaaacacctcctgggggtggagaacaccctgggccagagaaccaccagatactacgacggtcaggggcatgtggtcgccgagaccgatccccgagggttcagcaccggctatctctatgacggcaaccataacctgaccagagtaaccgacccgttcatcaggtacaccgacaccacctacgacagccagttccgtcttaccgacgtgaccgaccccctggggcacacgactcacaccgattacgacaccaagcatcaccccgtcaaaaccaccgtctacccggccacaggccaatccatctacacccagaaaagctactatgccaacggcctcgtgaacaccaccaccgacggcagaggtgtcatcaccaccctgacccaggatacctacggcaacccggccaccagcaagacctccacggcccctgccatcacgtatgtctacgacggaatcggccgaatgacctccctcaccgaccaggaaggggccaagacctcctttacctacgacaagaggagcctccccaccggcagcaccgacccgctgaccaagaacacctcgctcacctactacgacgacggcaccctctggacgaaaacggaccgcaacggcaagaccaccaccttcacctacacccctaccggcaagacgaacagcatcgcctatgccggggggacaagcgtaacgtacacctacgaccaggacgacaacctgaccaaaatgctggactctctggggacaaccacctacggctacgacgacgccaaccgcctcaccagcaccaccgacccacggggcttcgccatcggctacgaccgcgacgccaacggcaacatctccagaatcacctatcccggcaacaagacggtgagctacacctacgatgccctgaaccggatcaaaaccgtcaccatcgactggctcaataaaaccgccacctacacctacgacgatgcaggaaggatgcttgatcttacccacttcaacaatacctacacccgctacacccacgacaacgccaaccggctcaccgctctcgaaaaccggctctccaacgccggaagccccatagctacctacgccttcaccctggacggaaacggcaaccgcaccggcgtcacccagaccgtgcccatcgcgctgaacgccaccgcctcaaacacgaatttcaccatgaacctccagaagaaccgcctcgcccaggctgggagcaccagctttacctacgacaacgaagggcagcttgccaccaggacaggtgacatctatactttcgacgacgcccatcggctgaccaatatcaccggctcggtcagctaccagtacaaatacgacggcgccgggaaccgcctggaggcgacccgaaacggcgtaacaacgaggtacatctacgacgccaacggcaatctcctggccgaggcggacggcaccaacgccatcacccgttactacatctacggcaatggcttgctcgccatggtggcctcgggcaaccagccgtactgttaccacttcgacgcaaccggccacaccgtggccttaaccgatgccggcgctaatgtggtgaacaggtatgcctacactcccttcggggctatcggcaaccagcaggaaaccatcagccagccgttcaagtatgtgggaaaatatggcgtcatgagcgagccgaacggcttctattacatgcgagcacggtattatgatgccagcgtcggcaggttcatcagcgaagaccccaagggcttcgacggtggggatgtgaacttgatggtttatgttggcaacaaccccgtcatgttgattgatcctaatggtttaagtgctttcggaaaaatctggaaccttcccaataccctattaggactggcttggggcggtattggaatgcttggaggtgcacacgcatccattggaaacaatgcaattcaattcgaaaaacatccttttatgtttggcgcgattacattagggaacaccatatcttacgcaaaagacttcggaccaaatacaatgctggacaatggcactgttggtaagcatgaatcacaacatacgattcagggtgaacagttggggccgctttatcttccttccaacattcttggtttagccgcaggacaaataatcaatggaaatacacatggccctgcaaattggaacgaaagagggccacaatcaacaccgccaagtccttggggaggatatggaaaatga

SEQ ID NO: 118 - DNA, 7284 bp, Kitasatospora seta
atggcggcggtgccgtccgccgaggcactggccgcgaagcgggcacgcgacaccatctggacgccgcccaacaccccgctgggcagccagaccaagtccgtcgacggcgagaacctcgtcccgggccgcctgcccggccccctggagccggaaccggccgactggacacccggcggaccggcatccgtgcccgctccgggcagcgcggacgtcaccctcggcttcgactccgcggaggccgccgccgcccgcaaggccaccggcggcgccgcccccgcctccgacggcgcggccctccgcgcgggctccctccccgtcgtcatcggcgcggcgaaggacgccaagagcggcgcccaccggatccgcgtcgagctcgtggaccaggccaagagccgtgccgcacacctcgacagcccgctgatcgcactcaccgacaccgagccggacaccccgccctccggtcggaccacgaaggtgtccctcgacctgaagggcatcggcgcccagacctgggcggaccgcgcgcgactcgtcgccctgcccgcctgcgccctggagacgcccgacaggcccgagtgccagcagcagacccccgtgcagagctccgtcgacctgcgctccggactgctgacggccgaggtcattctgcccgccgccaccgagggcaccgccccgcccaccaagagctccctcggctcgggcaccgcctccggcgtcgtccaggccggcctcaccacggcggcgcccgccaaggccgcgcccacggtgctcgccgcgaccgccggcgcgtccggctcgggcggcagcttctcggcgacctcgctgtcgccctccgcggcctggggcgccggctccaacgtcggcaacttcacctactcgtacccgatccagacgcctccctcgctcggcgggaccgccccctccgtgggcctcgggtacgactcgtccgccgtcgacgggaagacctccgcgcagaactcccagtcctcctggctcggcgagggctggggctacgaggccgggttcatcgagcgcggctacaagtcctgcaacacggccggcatcgcgaactcctcggacatgtgctggggcgggcagaacgccaccctctcgctggccggccactccggcaccctggtgcgcgacgacaccaccggcgtctggcacctgcagagcgacgacggcacgaagatcgaacagctcaccggcgcgcccaacggcctgcagaacggcgagcactggcggatcaccacgaccgacggcacgcagttctacttcggccgcaaccacctgcccggcggcgacggcaccgacccggcgagcaactccgccttcaaggaaccggtgtactcgcccaagagcggcgacccctgctacaactcctccaccgccaccggctcctggtgcacgatgggctggcgctggaacctcgactacgccgtcgacgtccacggcaacctgatcacctacacctacgcccaggagaccaactactacagccgaggcgccggccagaacagcggcagcggcaccctgaccgactacacccgcgccggctacctcacccagatcgcctacggccagcgcctgagcgagcaggtcaccgccaagggcgcggccaaggccgctgccctcatcaccttcaccgccgcggaacgctgcgtcccgtccggctcgatcacctgcaccgaggcacagcgcacgaccgcgaacgcctcgtactggccggacaccccgctcgaccaggtctgcgcctccaccggcacctgcacccgggccggcccgacgttcttcaccaccaagcgcctcgcctccctcaccacccaggtcctggtctccggcgcctaccgcaccgtcgacacctggacgctcacccattccttcaaggacccgggcgacggcaacgccaagtcgctgtggctcgactcgatccagcgcaccggcaccaacgggcagaccgcggtcaccatgccgcccgtcaccttcacggcggtgatgaagccgaaccgggtggacggggacctcaccctcaaggacggcaccaaggtcaccgtcaccccgttcaaccggccccgcctccagcaggtcaccacggagaccggcggccagatcaacgtcgtctacaccacctcctccgacgccgcgcaccccgcctgctcgcgcctggccggcaccatgcccgccgcggcggacggcaacaccctcgcctgcgcccccgtcaagtggtacctgcccggatccagctccccggacccggtcgacgactggttcaacaagtacctgatcagcgccgtcaccgaacaggacgcgatcagcggcaccaccctgatcaaggccaccaactacacctacaacggcgacgccgcctggcaccgcaacgacgccgagttcaccgacgccaagacccgcacctgggacggcttccgcggctaccagtccgtcaccagcaccaccggcagcgcctacccgggcgaggcccccaggacccagcagaccgcgacctacctgcgcggcatggacggcgacgtcaaggccgacggctccacccgcagcgtccaggtcgccaacccgctcggcggcccggccctcaccgacagcccgtggctggccggctccagcttcgccacccagacctacgaccaggccggcggcaccgtcatctccgccaacggctccgtcgccggcggccagcaggtcaccgccacccacgcccagagcggcggcatgccggccctggtcgcccgctaccccgcctcccaggtcaccaccacctccaagtccaagctctccgacgggacctggcgcaccaacaccaccgtcagcaccagcgaccccgcgcacgccaaccgccccctcagcagcgacgacaagggcgacggcacccccggcgccgaactgtgcagcaccaacggctacgccaccggcaccaacccgatgatgctgaacatcctcgccgagcggacggtcaccaagggcgcctgcggcacccccgtgacctcggccaacaccgtctcctccgcccgcaccctctacgacggcaagccctacggccaggccggcgacctcgccgagtccaccagcgccctgaccctggaccactacgacaccggcggcaaccccgtctacgtccacaccgccgcctccaccttcgacgcctacggccggcttaccagcgtcagcgaggccaacggcgccacctacgacgccgcgggcaaccagctcaccgcgcccaacctcacccccgccaccacccgcaccgcctacaccccggccaccggcgccatcgccaccaccgtcacccagaccacgcccaccggctggaccaccaccctcacccaggacccgggccgcgccgaagctctggtctccaccgacgccaacggccgcgccaccacccagcagtacgacggcctcggccgcctgaccgccgcctggtcaccggagcgcgcgaccaacctcacccccagccagaagttctcctacgcggtcaacggcaccaccggcccctccgtcgtcacctcccagtggctcaaggaagccggcggctacgcgtacaagaacgagctgtacgacggcctcggccgcctgcgccaggtccagcgcaccagcgacacctactccgggcggctgatcaccgacaccgtctacgactcgcacggctggcccgtcaagaccgccagcccgtactacgagaagaccaccgcgcccaacagcaccgtctacctgccgcaggactcccaggtgcccgcccagacctgggtcaccttcgacggcatcggccggaccacccgctccgcgttcgtctcctacggacagcagcagtgggccaccaccaccgcctaccccggcgccgaccgcaccgacgtcaccccgcccaacggcaaatacccgaccagcaccttcaccgacggccgcaaccaggtcagcgccctgtggcagtaccgcaccgccacccccaccggcaacccggccgacgcgaccgtcaccacctacacctacgacgccgccaaccggcccgccacccgcaaggacgccgccgggaacacctggagctacggctacgacctgcgcggccgccagaccaccgtcaccgaccccgacaccggcaccaccaccaccgcctacgacgtcaactcgcgcgccgtctccaccaccgacggcaagggcaacaccctcgtcgtcagctacgacctgatcggccgcaagaccggcctctaccagggcagcatcgccccggccaaccagctcgccggctggacgtacgacaccctgccgggcggaaagggcaagcccacctcctccacccgctacgtcgggggcgccggcggctcggcctacacccaggccgtcaccggctacgacgccggctaccggcccaccggcacctcggtgacgatccccgccagcgaaggcaagctcgccggtacctacaccaccggcctgacgtacaacccggtcctcggcacgctcaagcagaccgacctgccggccatcggcgcggcgcccgccgagagcgtcatgtacacctacaacatctccggcgtcctgcagaagtcctacagcgacacctactacgtctacgacgtgcagtacgacgccttcggccgcccggtccgcacgaccaccggcgacgccggaacccaggtcgtctccacccagctcgacaagaccgactacacctacaaccaggccggcgacgtcacctcggtcaccgacgtccagaacggcaccgccaccgacgcccagtgcttcacctacgaccacctcgggcgcctcacccaggcctggaccgacaccgcgggctccaccagcaccaccagcggcacctggaccgacacctccggcaccgtccacaacagcggctcctcccagtccgtccccgcactcggcgcctgcgccaacgccaacggccccgccagcaccggcagccccgccaagctctccgtcggcggcccctccccgtactggcagagctacggctacgacagcaccggcaaccgcaccaccctcgtccagcacgacaccaccggcaacaccaccaaggacaccaccaccacccagaccttcggccccgccggatcggtcaacaccgccaccggcgcccccaacaccggcggcggcaccggcggcccgcacgccctgctcaccagcagcaccaccggacccaccgggacccaggtcaccagctaccagtacgaccagctcggcaacaccaccgcggtcaccgagacgtccggaaccaccaccctcgcctggaacggcgaggacaagctcgcctccgtcaccaagaccggccaggcccaggccaccagctacctctacgacgccgacggcaaccagctcatccgccgcaaccccggcaagaccaccctcaacctcggcagcgacgaggtcaccctcgacaccgccgccaactccctcaccgacacccgctactacagcgcccccggcggcatcagcatcgcccgcaccaccggacccaccggcgcaagcgccctcgcctaccaggcctccgacccccacggcaccgccaacgtccagatcaacgtcgacgccgcccagaccaccacccgccgccccaccgaccccttcggcaacccccgcggcacccagcccgcccccaacacctgggccggcgacaagggcttcgtcggcggcaccaaggacgacaccaccggactcaccaacctcggcgcccgcgaataccaacccaccaccggccgcttcctcaaccccgacccactcctcgacgccggcaacccccagcagtggaacggctacgcctacagcgacaacgaccccgtcaacagctccgaccccagcggactcatcaccaacgccctggccgacggcgacacctacgtcgcccgccccgccgccttctgcgtcaccatgtcgtgcgtcgagcagaccagcggccccggtttctgggaggacaagcgcgtcggtgacgccgtcttcgccgccgtcgtccaggccaccacgcagagcaacggcaacgggtcatcccagaccaagaaagagaagggcatctggggccaggcctgggactggaccaagaagaacggcggcgccatcctcggagcgctggtagagggagcggtcttcagcacatgcttcatcggagctggattcgccgcacctgcaacgggaggaatcaccgtcatcgccggtgctgcggcctgcggggctgtggccggcgaggcaggggcactgaccaccaatatcctcaccccagatgccgaccactccgtcgacggcatcaccaacgacatggtcgttggtgaaatcaccggggcggctgtcagcgcagcgagcgagggcgcaagctccctcgccaagccggcggtccgcaaactcctgggcatggaagccgaggaaggactcgaggcagcaggccgcgccgccaccggaccttgcaacagtttcccggccggcgtcaccgtcctcctcgccgacggcaccaccaagcccatcgaacagatcgcccagggcgaccaggtaaccgccaccgacccgcagacaggcaccacccaggcagaacccgtcaccgacacgatcatcggccacgacgacacggaattcaccgacctcaccctcaccaacgacgcagacccccgcgccccgcccagcgagatcacctccaccacccaccacccctactggaacgccaccaccagccgctggaccgatgccggcgacctcaagcccggcgaccacgtccgcacccccgacggcaccgaactgaccgtcaacaccgtctacagctacaccacacaaccccggaccgcgcgcaacctcaccgtcgcagacctccacacgtactatgtgctcgctggaaatacgccggtcctagtgcataacaccggcccgggatgtggtgagccgggattcgttagtgacgctgctaattctctctcgggcaggcgcatcaccacgggacaaatatttgatgcgagcgggaatccgatcgggcctgagatcacgagcggcggcggcagtctggcagatagggcgcagagttatcttgccgactcccctaatattcgaaatctgcccgctaaggcgagatatgcgtcggctgaccacgttgaggcgcaatatgcagtgtggatgcgagaaaatggagtgaccgacgccagtgtggtcatcaatcaaaactatgtatgtgggctgcccctaggctgccaggcggcggtgcccgctatcctccctcgcggctcgaccatgacggtatggtatccagggtcaggaagtcccatcgtattgcggggagtgggttaa

SEQ ID NO: 119 - DNA, 6654 bp, Methanosarcina acetivorans
atgtttttcatggtactacaggttccgatccataccagaagactgctttcaatttttatgattattgtattgctcacaccgaatgtatattgtcttgaaaacacagaggcaagccaggacgtaaattccgagggttcacaagttgattccgagtcatacgaggaaaataataaaaacatagtagaatctgaggaagaaacgagtgaaacaatttccgatcttgatagtgaaagtgtggacgatgatacagaaactgtttctgaagatactatgttaactgcaactacagtttccgaagatgaggagcctttaagggatgcaaaagcgtatcttagtcctaccctggaaaatgaaaacaattactttgacacaagcctgtttacaggttcttttgtttattcttatccgattgaaactttaaaaggaagaactggattagagccggaggtttctctaacctattccagtgctacaggctcaaaaggaacatacggttcactggggattgggtggtcattgaatgagaactgcattatcagggataccagatatacccctgaaaacacaaatgatgatagatttattcttgttttggacggctcaacatataaactcgtctatgtggaaagtgacaactcatatcacaccgaaactgaaagttttatgaaaattgaaaagagtgcaaccagtagcaattctttcggggactactggaccctcaacatgccggacgggacaaaatatcgttttggttataatattgattccgaacaaagaaactccgttgaatcaagaaattatgtcagtaaatggtggctcgatcttatagaggacgtcaatggcaacaagattaaatatacgtatcttgaaaatccggtaagtggcgaggtcggaagcacatatcctgacagcataacctacaacgacaatcatgcagttattgattttgagttcacggaaaaaccacgtgtattcactatttatgaatatggtaacaaaattatcgaaaaaaacttgatctccagtattactgttcgtaacgatgaaaccgttctctggaaatatgatcttgattatgaaacccaacagttaaaattacatctgaaatccattacaaaaacaggattaaacaatgaagagttcccacctactgtttttgaatatgactcaataaccgaagggtggcaggaaagtagttcctggaccccaccaacttccatgtcaggagacaagggaagaagaattgcagatgttaatggcgacggattagatgacatccttaaaggatatgtagatagtgacggggatgtttattgctcaacctggataaataccggagatgactgggaactgaacagttcctggacaacaccaacatatttcaggcattataatcatgatgggggagctcgccttgcagatgtcaacggggacggattagttgacattatccagcacggattttacatttcctctgcctggttgaataccggtaccggttgggaacaaaacaactcatggatacctccactggattttggctggtcaagtgattatggtgtaagagttttagatgtcaacggggacggattagttgacataattaagggttacaaaaacgatcgtggaactatatactatgatgcttatctcaataccggtgaaggctggatacaggataattcatggaacccgcctacttacttctcatacgataatattgatacaggcgtacgactcacggaccttaacggagacgacctggtcgatatctttaaactacgctcttcatggttaaacaccggcagtggatgggaacaggataactcctgggcgcccccaatatctctcgactcagatcagggtgtagtcttagtggatgttaacggagacggtttgactgacattcttaagagttattataacgatgccgggtacacttacgatgcctggataagcactggcaatggctgggaaaacgataactcatggaatccgccaacgttgatcgcaagctacggcaaagaccagggtgtacggtttgctgatttgaatggagacggtttgacagacattatcaaagcaggctatagcgattactgtgcctggacaaacacgaacactgagagtacagaaaattacaaaactcagggcctgctcaaaaaaatacagcactcaaccggtggaagcacgaccataaaatatgaaccttctacgctcttcgataacaccggggaagacggcgtttcggatttgaccatgagtatgtgggtcacaagcagtgtgacaggagataatggtattacaggcacgggaagcgtagtttcaacaacagattacacctataaaaacggaatgcagtacttcgacccaccggaagaaatcgaattcagaggatttggtgaagttactgttgaaaacgagtattcgatagtaaagcactttttccaccaggacaacgtcctcaagggcatcgaacaccatactgaagtctgggacaaaaacggaaacctttacagttcctcggacacggaatatactgctcaggaaatataccctgatgtcaacctgattttgctggactcggagtccaaaacaaggttcgacgggctggtacagaacccgaccagttcagccggctggtcatatctcaccgaatataacgaatatgacgattacgggaacccgctttccataacagatcacggcgatgtgaacaatgccggggatgaaaaatattaccattttggatatgccaatgcagaaaatccgtggatcctcggaaaaaaaacacatgaatgggtggaagactccgatcatgtaaagaagagcgaatcatggtactattatgacgaaacaaatgacaacagtgccattagcaaagggcagctcactaaaacagtattatggaacaatatgggagataatcccaatgttctgtacgattacgataactatggaaatataatccggattacaaatccggaaggggcttcaaagaacataggatatgatgaaaaccatttataccccgtttacatcgaaaacgcctttggtcaaaaagagtgttatgaattcaacgaccttggcaggataacgaaaataacagacagtaacgacatttctatagcgtatatctatgatgacctgcacagaataacaaaagtactgaaagtcaatgacacacttgattctccatctattgagtatacgtactatcaggatggagtagcgcctgaaaaaattttaaccacaacaaaagaatgtggtagtgaagagaacaattacgtcattaatggttctgtattcagcaattataaacgtatcacaatttcaccatcatcagacggaaccctgactgattaccaggtgaagctggatattaactatgaatcagagatgcaatccgattttgatgatcttcgttttgttgatgaaaatggcattctacttccatattggatcgaagaaaaggttgattccagttatgcaaaagtctgggtaaaggttcctgtaatcgatggaattgatggtgctactatcaaaatgtattatgataactcatatgtttcatcagcagagaatggcgatgatgtttttgaattctttgatgatttcgaaagcggtgtaatagacaatgctaaatggaatgaagttggctcgccgacaattgttgatgacaatggagacaaagtgctgaaggtgacaccaagcaacgaggtaaatacatttaataagttttccggtacagagtacatcgttggggggttgatgaagttttcatcattcggcgactacggaccacgcatgacacttgatgtcagaaggcaaaatgaccaaacgatacttgcgacatgtcgtatagaatcgtatgcggatgggacaggaggaacaggcacgtcaatacgatattatccgggttcaggaagtttcattacagttgcacaagctcggccatcgtggtctaccggagtatggaatagattttcattttcctcaacgaatagtacacagaaactaacaattaacggccttgtcatttctggcacatgtgaaaacaatctttcaggttcgataaatatacatacctgggacagtggcaatgacattagactttcttatttatatgtccgtaaattcgcatcgtctgagcccactgttgtgcttgaagaaaaaaactatgtctctactttcgactccactgactcatacgacggcttcggtcaattgatccagaaaaagtatgaaggggaaggcggctggattatccagaacaccgcatataacgaactgggccttgtagaaagtgccgaaatcccgcattattcggaccaaaccggcttatccgtaacctacgagtatgatgcagccggacggccaacggttatcaccaatactgacagcactaccctgacatacgattacaaccttgacgacaccacgattaccaaccagaacggcgttgacaaaacactaacaagtgatgttttcggaaatattgtcaaggtatatgagttcaacgaaggcgaaacttacgttacatcctacagttacgatgccctgaataatctcatcgagattacgccgggcttcaatgaccctcaggctccgcccagtgtttatttcacctacgattccctcggcaggaaagtggcaatggacgactctgacatgggcagctggacctatgaatacgacctgaacggaaacctgataaaccagaccgattcacggggagtttcgacaatcctcagttatgatgacctggacagggttactgcaatagattaccctaacgatgaggacatcagtttcacctacgaccttgaatttaacggtacgctttcccgggtaacaaaaggacccgcatcatcaagttacgactacgacctgcgctacagggtagaaagcgaaactttaaccattgacggtacaccctacaccacgtcctacgattatgacagcatggacagggtcacgggaatcacctacccgaacggcgaagccgtcagcctgacatacaatgcgcagacccttcttgaaagcgttgacggcgtgattgacgaccttgactataacgcaaggaaccagatcacaagaaaggaatattccaacggcgtaatcacaacctacacctacgacagtcaaaaactgctgctggacagaatctattccgcaggcctccaggacctcaactacgatttcgataacgtcggcaatgtcctcgagatcgcggacaacacccaaaattccgtaaaaacctacggatacgacgaccttgacaggctggtcagcgcagatatgtcggtcaacagcgtcccgacctaccagagagatttcacctacgaccggtatggcagtatcaggcaggtggataacaacggcgccacagtctcctcttacggatactctgcgaccccgtcccacgcacctgttacctacaacggaaacaccctcgactatgacgcaaacggaaaccttgtcgacgatgaggatttcatctacgtctacaacgatgccaaccagttaagtgaagtccgttactctgccaataattcccttgtagaaaagtactggtacgatgcaaacggccagagaatcaagaaacagaattccgatggagaattcacctattacatcaacaagttctacgaaatcgataacggcatctctaccagctacttcttccgcgatgatgaacgcgtagccaaagaaacatccgaaagtatggagtggtacctctccgatcacataggcagcacttccctgatggttaacgagaatgggcttgaggtcgaacgcaccgatttcccatacggacaggttcggtcaggcgggctggagaaatacgggtttacagggcaggaaaatgatgccgatacagggctgatgtactacggtgcgaggtattactcgcctgagtacagggttttcgttcagccggatacaatgcttcctgacccgtataatccgcaggcgttgaacaggtattcttatgtgctgaacaacccggtgaagtatactgatccgagtgggcatgttgtggacgtccttgtggatggcggatttcttttgatggatttagacgacatccgcaccgggaatgctgataaatggacatacatcggtcttggtgttgaccttgtatgtgctttcgttccgggtgtgacagggggaaggctaggagttcaggctctggaggaaacagttactcatgcggataacgttgaggatttgtttaagctactggataaaacggtggatgcagagaagaaagttgacgatgtgatagattctggaaaagttgctaaaaatagtaaccaaatttacaacgttatcaaaagagcggacttgcctaatacaaaaatcacaagttcgaaattacaacatgaatggaaacatgcaactgatttcggaataaaaggcaattggaataaagctaatggagatctatatgaaaaagctattcagaatcatataaatactgcacctgaagtttataaatcgacttatagacaaaatcaagatgtttatgtttatttgaataaggagacaggggtgggagtatacacagatctttctgggaattatattggagctggaaattcagtccggaacagattaagtatcatacaactaatggacttaaaatag

SEQ ID NO: 120 - DNA, 5385 bp, Microbacterium testaceum
atgagcgatgtcgatctcgaggtgtacggggcacccgatctgacgtacgacttcggtctggcggacgcggtggcgtcggcggccaactcagcggcgtcggcggtggagggccaggcagggacccgcgcgtcgtatgtcaccacggcggggcaggacttccggggatacttcagcgagctgttcgcggccaacgcggcgaccgccgcgggcgacgcgcgagagctcgcgtcgaggctccgcgatgtgtcgtcgttcatcggtcgtctgagcgatgcggcccgcgaagagaacgctcgtcgaaagcgcgctcgtgagtggaaggcccgcgtcgaggcacgccggtcgaactggctggatgccacgtgggacgacatcttcggcgaggagccgccgccccagggcggcgagatcgagccgcccgtgttccaggcgaccccggtgaacgcttcggcgcgtcagacaccgagtgcgggcggcggcgggggaggaacgtcctccgcacgaccggagaacctccgcaccttcgccacgggcaacgcgaacctcgacgcggctctgtcggctcaccccgggcgcgtgtcgtcggcggcgagcgatttcatggccacgtgcgacttcggcgggatcgacgtgagtcccgtcgtgaccggattccaaacctggctcgacgcgaatgcgaatgacacggcgtgggcgaacacgatcgcgcaggcgttcgaggacgctggcacgaacggcgggatcgggacggtgtcggatgccgcgttggcggcgtctttggcggcggcgggggtgtccgcgacgcgtcaggatctggtgatcgaccccccgaccgcgtggggtggggcgccgaccacggggttcgtgaacgaccctgtgaactccgcgaccgggaacttcttggagccggagaacgatctcccgttccctgcggcgacgggtctgctgtcgctgacgcggatgtacaactccctgaacgacggggacggggtgttcggtctgggatggtcctcgatcctcgacacggccctgctgctgtcggatgatgatgcccggttcgtgatggcggacgggcgacagatcgtcttcggccgtgacgggcgcgactgggcacgggcgacgggggagaactactggctgaaccgtgtccgtgctgccgagtttgccgcgcggggtctcatcgggccggacgggttgctggtgaccgacaacaccggggcgtggtgggcgttcaccaccggtggcgactggctcggtgcgggtgccggggctggcaacgtcgtcgccgtcgtccgggatgccgcgggcgcgatcgtcgccctggagcactcccgtgaccgccgcgtcgacgtggagtacgcggacgggctcgtggcatccgtcacggcatcggatggtcgccgggtggagtacctgtacgacgaggaccgccgcctgaccgcggtcacgggtccggcggggacgcggacgtaccggtggaacgaggacgacctcatcgaccaggtggtctcggctgccggggtcatcgagtgcacgaacgtgtacgacgtgcaaggtcgggtgcgggagcaggtcacggagttcggtcgtcacacccgcttcacctacctctccggccgcgtcaccgaggtcgccgacgccgacgggtcgaacgcgaacacgtggatcgccgaccgcaagggccgcctcgtcgggatcatcgacaccgacgggaaccgccagtccatggcgtacgacccgaacgggaacctcgtctccgtcaccgaccgcgagggccgcatcaccgtccacgcctacgacacccgcggccgcagaacccgcaccgtcacccccgacggcgccgacatcacctacgggtacgacgaccacgaccgcgtcaccaccgtcgtcaccgccgacggcggcatcgtcacctacgactaccccaacgacctcgaacgcaacccctcgcgggtcaccgaccccggcggcggcgtcaccgaactcgactgggccgccgggctgctccgccgggtcgaagaccccgagggtgtcgtcgtccgcttcgactacgacgcccacggcgaatcggtcgcgacgcggaacgcggacggggcggtcgcgaagctcgtccgcgacgccacgggccgggtcacccaggccatcaccccgctgggcgcggtcacgcggtacgtgtacaccgacgccggggtgttggcatcccgcgaagatcccgacggtgcgatctggcgctacgaacacggccccggcgggcagatcaccgcgatcatcgaccccctcggcgctcgcaccgaactcgagtatggcccccacggccacctcacccgcaccaccgaccccctcggccgcagcattgaccgctcgtttgacaccttcggcaacgtcaccggggtgacgctgccggacggtgccgcgtggggtttcacccacgacgccctctcccgtctgcgggagatcaccgacccggccggtggggtgtggacgcgcgagtacgacgccgtcggtgacctggtccgcacgaccgaccccaccggggtgtctgcggaggcgacgctgtcgcgcaccgatgcgacccgcacggttcagacggcgttcgagcagacctcggtgagctacgacagctacggccggccggagaagatccaggatgccgccggcgacgcctcgttgatcacttacgatgcctgcgggcgtgccgtcgaggtcctcgacgcggacggcggcctcacccgcatcgaccgcaacctcgccggccgtgtcaccgcgatcaccacacccgcgggacgcacgacccgctacgagtacgaccactgcggccgccccgtcgccgccatcgacggcaacgacgcccgcaccaccctcgaatacgacgccgattcccgcgtgactgcccgggtcctccccacgggggagcgggtggagatcgagtacgacgaggtcggacgtgtcgtccgcgagcgcgtcccgggctcgggcgtctcgcgtttcggttacgacaaggtggggcgcctgacgttctcgcacgacacccggttcggcatccgtcgcttctcctacgaccccgctggccaactcgtcgccgccacgaacgggatcggcggtgtgacccggtacgcgtatgacgagcggggccgggtggtgtcgatcgccgatcccgccggcggggtcaccacccgcacgtacacgcatctcgacaaggtcgcctcgcagaccgacccgctgggccgggtgaccaccgcggactacgacgcggcgggtcgtcagatccgccagaccagccccgacgggaccgtgacggagtggtcgtacgacgacgcgggcctcgaatccgggctgagcgtgaacgggcgggtcgtgacggagatccgtcgcgacgcgcgtgcccgcacggcgacgatcgtcgatcacaccacggccgagccgaccacgcacaccctccggttcacgcgcctggaccgtctggccgagagcacgagcgacggtcgctcgacccgctgggagtacgacgccgacggtgctcgcacccgcctcgtcacccccgacggagtgacggtcgattacacgcgggatgccgccggccacctcacccgcatcgaccactcccgcctcggcgcggtgcactacacgcgcgacgcgttcgggcggatcctcgaagcccgcgccggcgacggcctccagacctgggaataccaggacgggttccccgtcgcgcacacccgcaccgacgccgacggcgccaccctcacccgcatcacccgcgataacgagggccgcatcaccggcatcgacggacccgacggcaccacccgatacacccacgacgacgccggacaactccgctcggcggtcggcgacgggcacgcgagcgcgtgggagtacgacaccgccggacgcctcatccacgaaacccgtgacgatgtcgagcgggcgttcgcgtacgacaccgccgggcaactcctcaccctcaccgcacccgacggagacacgacctacgcctacgacgggcagggccgccgcacccgcgagaccacccccgccgggtcgacgcagtacacgtgggatgaccgcgggtggatccgcgcgatcaccacacacacccccgacggagaacgtcgcaccgagctgcgcgtgaacgcgctcggagaactcgccgaggtcgacgggaccccgctgacctgggatgccggctcctacgccgccaccccgctcaccgtcggggacacggacgtgttccacgcccccggcgcgatcaccggcatcggcgacacctggaccaccggcggatggcgctccacccgcacgacaggaaccgacgacccctggcaggcgttgaccgccgcccaagccctcggtgggggagccgtcggcatcagccccgccggcggcctcgaggtcgcggggctcgagtggatgggcgcccgcgcctacgaccccaccacccgcggattcctcagcaccgacccgatcaccgcccccgccggcgccgcctggtcagcgaacccctactccttcgccggcaacgaccccctccacgccaccgaccccctcggcctccaacccgtcaccgacgaacaactcaccgcctacgccaacgcccaccaaggcgccctcgccacagccggcaacgccatcggcgaatggtggaacgagaactgggaatacgtcgccggcggcgccatggtcatcgccggcggcgtcatgatcgccaccggcgtcggcggccccatcggtgccgccctcatcggcgccggggccgacaccatcatccagaaagccaccaccggcgaagtcaactggggacaagtcgccctcaccggagcgttcgggctcatccctggagccggagccgccggcggcctcctcgcccgcaccggcgccaacgccgcacaaggcgcggtggagaacaccgcgcagtacctcatcagcggccaacccatcacccccggcggcctcctctccaacgccgccaccggcgccaccatgtcggccgtcaccgccggagcgctcagccgcgtccccgcgggcagcgccatcaatcggctggatgaggaggtgccgcagttcgtcgatctcgcaagccccgcgcgtcgtgagcacatcttggatggcgatctgacgggcggtggccaccgctggcctggagcagaaggcaagacgcctttcccgcagggctggtcggatgacaagatcatgcacgaaatatccgatgtcgccacggaccccagtctcacctggcgtcaacagaccggtgcacccggggccgatttcacaaagaacggaagacctgtgcgctatgcggtggagggggagcgtgacggcgttcccctgagagtcattatcgagccctctggggatggaatcatttcagggttcccactccgatga

SEQ ID NO: 121 - DNA, 4194 bp, Pantoea ananatis
atgtttgaagctgcacgcctcggcgatgatatcggtcactctcatgccctggcgggcatgattgcaggcactatcgtcggtggactgatcgctgcggcgggcggtattgctgcgggtgcattgatgattgccgggataggcgcctcctgccttggcgtgggcgtattgctggttggactcagtatcggcgtgggttaccttactggcgaactggccaccgccgcgcgagacggaatagcggatgctggggcggccagcatgaccccaaagggcaagattaccaccggttcgcccaacgtctttattaacagtaaacccgccgccatggccaccaacagcatagtggcatgcaaggacgatggtccgcagcagatggcagaaggctcctcccgggtgtacatcaacggcctgcctgcatcacgcattgacgatcgcaccacctgcgatgccaaagtgatgacgggttctgacaacgtctatatcggcggcgagcctgaacaaacgctgcctatccaacctgaagtgcccgaatgggtttataaagcctccgatcttaccctgctgtttgccgggctggccggtggcgtgggcggtgcggctggcaaggtcggcgcgctgggtaaattactgagcaagattcccggcatcaataaaatcgcccgggtggcctgccgtgctggtgccttaatgaccggtgtggcggccgcaggtattcttgcccgtcccgttgatatcgtaagcggccagaagtttcttagcggcgatgatgaactggattttgtgctgccctcccggctgccgctacgctggcagcgctactggcgcagcggtaatcccggcgacagcgtattaggccgtggctggaacctgttctgggaaacacggctggaacgctaccaggatgggctggtctggcgtgcgccctccggcgattacgtctcttttcctctggtgcccaaaggccagcgtacctactgcgaagcggagaaacactggctggaacatcatcgggacgacagttggtcattgtatgacatcagcggtgagcgctggcattttatgcccctgcgcgatgatgccccttctcttcccctctgcctgaccgagccctgcggcaatgagattcagttcgactggaactccgatcacacattggccgcgctgacagacagtgccggtcagcgcgtaacctgccgctatgcgaataaccggctcgcaggtgcctggctggatgacgatatttgtctggtcagttacgcttatgatgatatcggccaactcgttacggtaacgggccggggcggtagcgtgcgccgacgcttccagtggtgcgatggcctgatggtcgcccatgaagatatgaatggcctgctaagtgagtatcgctggcaggagatcgatggcctcccaagagtggtggccttccgtcacagcggcggcgagcagctggattttgagtacgattttgataatggcatccgacgcgcgcgacgtgatgacggcgttgaagctcactggctcattgacgatgacgatcatgtcgcccgcttcaccgacttcgacggccgccagaccatgctggtttactgcgcaggcgagttgtgcgatgtgattatgcccggcggcgccatgcgctgcagcaactgggaccgctatggtcgcatgacgcaggagatcgatccggtcggacgtcgaaccacttatcactggttccgcatgactgaccgtgtgatccgtacggactatcccgatctgagcgcgactcaggcggcttacgatcttaatgttcgcctgctgactgaaaccgatgcgctcaataacgtcaccacctatcactaccctgatgacacagaactgctgccagacagcatcaccgatgcaacgggcggcgtggtgaagctggaatggaaccgacaagggctgctgacgcagcgcaccgactgctctggcagcgtaacgacgtttagctacgaccgatttggccagcttgttcgcagcgtggatgctgaaggtcatgtcacccagcgcgagtggaatgacaagggacaactctgcgccattatccatccagacggcagccgggaaaccctgcactggaacacccaggggcagctcagtgcgtggcgcgatccgctggagaccgaagtccgctggacctataacgcactcggattaccggtgagcctgacggaccgcattggtcgcacgcgtcgctggcattacgatgcccgtggtaatctgctgcggctggaaaacggcaacggcggtgactatcgctttacctgcgatccgctcggccgtccattgagtgagatccggcccgataagacctcacgcaatatggaatggaatgctcgtggttttctcattggtttacaggaaaatggccagcccgctaatgacggtggcatagcccgacgctggcagcgctttagctacgacgacagcggcttgattacccagcgcacaacgcagcatgcagaataccactaccggcgtcatcgtagcggtcaacttgccagcctggttcgcacgccgaccagtgacggaatggcgcttggtatcgaagacgatgaaatcgcctttacctatgacgtcgcaggtcagctcttaacagaagccggtataaacgggaaactggattacgaatgggatgcactgggcaacctcacccatctgaccctgccgggtgaacagcaacttgcctggctgcactacggttcgggtcacgtcagcgcgattcgctttaatcagcaactggtcagtgaatttacccgcgaccgcctgcaccgggaaattcgtcgcagtcagggcgcgcgtgagcaggcgcgtcagtacgacagccttggcaggcgtacgatgcagcgcagtgaattgcatagcgaggtggtgctaccggaaaaagccattctggaacgcgctttccgctattcggcgcgcagtgaactggagtctgtcagtgatacgctgcgcggcgacattatctatggttacgatgatgaaggccgcctgctgaagcactacgaagccagacagggccacagcacctcgcattttacttacgataatgcggacaacctggccgccaacgacgatgcactgcacgcgttgccggttaccgacaatcgagtgcatcactggcagaacctgtttatgaagtacgatgactggggcaacctggtcagtcgacgcagcggcctgcatgagcagcattttacctatgacgccgaaaaccggctcatcagcgccaaaggcaatggcccggacggcgggtttaccgcgcattatcattatgatgcgctgggcaggcgcacctgcaaagtggtcagcacccagcacgatcgtaaagaagtccgttttctgtggcagggctatcgcctgttacaggagcaacaggataatggccagtgccagacctatgtgtacgatcccaacgaggcctggagcccgctggcgcgcatcgaccatatggcagcaggcggccggggcgatgtgctgtggtttaacaccgatattaacggggcaccgctagaggtgaccgatgaacggggcaatatccgctggagcggtcagtacggcagctttggcgaggtacgccgacagacggagggctttacccggctggcaaaacagtctgccctgccccatcagccgctgcgctatgcgggccagtatgcggacagcgaaaccggtctacactacaatctgtttcgctattacgatccgcaggtgggacggtttacggttcaggacccgatagggctggaaggcggctggaacctttatcagtatgcgccgaacccgctgagctgggtggatccgctggggttgagtaattgcggtgctccaaacaaaaagacatcttatgaaggtatcagtcgcagagatgcgtttaggcaagctaaaagggatgctggaataccaatgaatcaacatcctagctctatcacaagacccgacttactagatgggagtggtaaaaaaatattagatagtactgggcagccaataaaaactaggcaatacgaatttgttgacaaaagaggtcagtccgtctttctacaagaacatagtttaggacataccaaggctacttctggtcatggagctgaacctcattttaatcttaggcctcttgacaacttgaataccggttcagttcctggtactcatggtcactataatttcccataa

SEQ ID NO: 122 - DNA, 4992 bp, Parachlamydia acanthamoebae
atgaaacacatatttttatttttatttctaacgctttgctgccgaattttttcgtttcagacttctttatctactcctgaacatattgaaaacgcccctgttcatctttaccttcatcatgccatcaatgttatcaacggtacgctttacgaagcggaaacagatttggctaccagcggagcctcttcattaactttaaaacgtatttacttccctcaagaacgcgcaacgagtccttgggaacacggttggcaatttaactatccccattatcaaagctcttcaaacgataaaaaagtaaataatcagcttgaatatgatgctcaaggtcgtttaatcaaaattcattcaaatcatgatgaacagattaccttttcttacactcaggatcatccactacaatgccatgtcaaaagtcatgacggacaaaacctaaaatactcttatgcttctcatacaaattctaaaaatcaaatttttcatcttttagaagaagcaaaactcccctccggattggtttggagatatcaatatcaagaacaccctcttgaaaaaaagatgcttttgatacacaaagaagggtctgaaggctattttgttcaaacagaatattatgatcaggaagaaatagattctattccttctaaagagagtccattaagaaattttagttgcggtaagatcaaatgccaatggcaaccacatggcatagataagacacctgttaaaaccgtgtccttggtttattcgccaggtaaaacagaagtttttgatgctctaaacaatcagaccacgtatcactacaatggctatggccagattaccgctgtcgaatattatttgaaagatgatgtccaagatcccattttatatcgcacggagaagtattattgggatagcaacttaaaaatccaagcacctattggaaagacgattgaagatagtcaaggaaacgtttggctctgtcaacgctacctttacaatgaagaaggaagcttaattcaagaaacgttgtatggaaatttgtcaggtcattgtcctagtcccattatcctagacgaacacggcatcccgaagaaccccgctattgaacattactcttcttactatacatacaaagataacaatctcgttcaaattaaaggagataacggttcttctttatcctttgtttatgataatcacttgttaaaaggtaaattctaccatgatcaagaacgaattcgcataagagagttttatgactacaacgctgatgatatcttgattaaaactatcaccgatgatggttcttcatatgatcccgatgatttaaaacacgtctctgaaagacagatcacttacatccatttattccaatcaggtccttttgtagggcttactgatagcattgaagagaaatatctcgatctaagtgatcaaacagaacatctgatcaaaaggattcagcatttttattccacaaatcataaactgatccgtagagatattttcaacagccatcaaaatttcagtttttccgaagttcaaaactatgatcatctgggtaatttaacgtatgtggcaacgccctcttggactcaagaatataaattcgatctttatggcaacatcctcttgaataagaaaacactaccatcaggggattcggaagaggttgtgaatcattatgattttcgaaaccgtctcattcgacaagaacttttttcttctgcgcgattatcaaaaatggcgctattttcatatgatctgcaagggaataaaatttccgaagatgatgggtatggcaatgccacctcctttgaatatgatggattgaatcgtttggtaaaaaccatctctcctgctgttgaaaatgaacaaggagaaaagatacaccctgttttaacatattcttacgatatttttgatcacattacctccatggttagtcccaaaggagaaatgacatctacgacctacaatattcgaggaaagccgttaaaaattacctatccagatctctctgaggagtcatttgaatattctttagatgggtctttaaaaagatggaacatgaaaaatgggtgctcaattgtttacgaaagagattttttaggaagggtcaccaaagctagcttacttgatgctcaaagtgttctcatacaaggcactcaagccatttattctacaagcaacttaaagacggtaatcgcgccttcaggagtcgtcattgatcacttgtatgacccttctggcaaacaaattggacaaattcaacatacagccgatacatctgttcatacgatttgtcattacgatgcaaccgaacaacttgtctctaccgaagaatggatcgcccccaacaaagaatattatacgaagactatttatcatcaaaaaggttcagtagtagaaagccagcaaggcaaaattttgtatgaaaccaaaactgacacgtcgactaaaaaacctttaaacgaaaaacgatgggtgaattccctgggtcaaaatgttttgctacttgaagagacagataaaaatggaaacctcatcagcttgctttacgatgcactaggaagaatggtggcattgaccaaaacatcctcttctggagaattattgtttaagcaggaatatcgttatgaccttgtcggaaacaaaatttggcaaaaatcgcaaaatgataaaaattcaattatccatgaatgggagtacggccctggtaaccacttgctcaagcatatagaaggaagtggtcttgcttgtcagcgtacgacctattacatctacgacaaggacaaactcgtcaaaacaatcaagcctaatggcgttgaacttatggccatctataatggcaggggtttgatcgagcatttattctcttcagacggaaccattgattattcctatgcctacgattcagcaaaccggattacccaattgattgatcatcgcttaaagcagacgactaaaagaacctactcttctacgggtcttcttactgatgaagaactaggtaacggtcttcagatgatccatgaatatgatgccaaaggaagaaagactaaagtcattcttcctgatgattcagctgttatttatacctacaaccctctttttcttaagaaagttcaacgtgtctcaccatcaggaaaaatttgctatcagcatacttattctttcgatatccatggacaattggaaacttcggaattgattcaaggattgggaacaatccattatcagtataataaggacggacgctgtgaagagatcaattctcctttttttaaggaaaaattattttatgatactgcagataatcttaaagcaaccatcatcactcacaacaatgaaactttaaatgcgcagtattcgtatgactgcttggaccagctcatccaggagcaatcttcttacttcgagcattcttatctttttgattccctattccaatgtcaggaaaaagatcatatcgcatatcaatatgacgatttatttcaacttttagatacttctgagcaatcttttgagtatgatcccaatggaaactgtacagctcaaattcaaagtcaacaacatatttcctatacttacgatgctttagaccgtttaattcaactcaaaacagatcatcaatatctcatcgaatatcaatatgactgtttcaatcgacgtctttctaagcttattaaagtttttaatgtttcggaaaatgaatggcaaacacaccatcaaatccactttttatacgacgaagaccgtgaaattggagaaatcgatccagaaggcaatatccaaaaactacgcattttaggtcaaggaatgggagctgaaattggagctgctattgccttggaaattcacgacaatgtgtacgctcctatttgtgatcatcgaggctctatcacttgtttagtcgatactgaaacagctgagattgtggaaagctaccaatattctgcttttggagaggaacagatttacaatgcaaaaaatgaacaagtgccattgagcccatcagcaaatccttggagattttctagtaaatatcgagaagacgaaacgcaattgattttctttggaaaaagattttatgatcctaaaaacggacgctggcttactccagatcccttacgcgcagactctccaaatttttacacctatgtcaataataaccctcttaatcatgtcgatttatatgggctattttcactcaaaacagcctttcagaaatatgcaaatttcacccaatggctcgcattaccttttggatcatcttcgttaaaacgttgtttaaaaaaatgctctgagcacctcatcgcacgccctttctttaatttgacaggcttttatatttatccttctgaaactggcacctatgggcatggagaatttagtgatcaagtacgagtcaccatgatcaatggaatattaaatacgtacgaagattttagttcgaccctgcggattgtatctgaaacgcatggaggagaaaatattcattatgtctttcgccccacccaaggtctttttcctgatttattacaagccttcatgtcaaaaattgggtacctttctccccatgttcgacagctcgcacgtacctggaaagacatgattcaagagatgggtggaaccgaaaatgggggcctcattatccattatgcacacagtttaggcggtacagatacttttacggctgctcaattactaacacctgaagagaagcggatgttgagaatttttacgataggatctcccacgcttttttctaatcaaggttttgaaaatgtcctcaactacgttagcaagcgagatggagtgtctttatttgaccctgtaggctatattaaaggaattttttcccaaacttcgaatgtcagctatgtgggaaccctaaaaggaatccctctcattgaccatttgatcgggtgggtaacttatacagatcttctcaagatattgggaattaaatttctgcaaagctacccaagccctgattattaa

SEQ ID NO: 123 - DNA, 5565 bp, Bacterium Ellin514
atgaagagtatcaagctagcagcgattgggggactcatattcctgtgcgccatcctattttacattcctcaccgggcgttggggcaattgaccattagcacacccacattcccgacgagcaacaccattcagcttactctgagcggtacgcaaacaaacctgctctacaacatccaatacacccccgcactcgttagtgttccgttctcaacgattgcgaccggggcgcagggacagacggtcttcaatttcacgatgggcagcagcaatgcgaacttttttcgggcttttgggatgacgaatgcctccggcccgctgatcgtcagcaccccagctttcagtccgggtgggggtgcatactcgatgccgcaaaatgtgattatttcctgctcaacgcctctcgtttcgatttattatacaacaaacggcgcaacgccgacgaccagcgacatttacattccctccggcggtacggtgtttctcagttccatagtcaccctgaaggccaaggcttttcgttccggctacgtggacagcggcgttgccagcgcgacttaccagatcaactctcccccgcttgtcagcgcggggccgcagcagatcatcaccagcgcaagcaccacccttcaaggatacgtcactgacgacggcctgccgaccggccacactctaaccaagacttggagcaaggtgagcggaccaggcaccgtgacgtttggaaacgccagccagacaaacacgacggcgactttcggggccgatggcgtttatgtgctccaactggttggcggcgacagccagtacaacgtgaccaataatgtcacgattgccgtcaaccccacagtatccgtttctcttaacaccccggcggacggttccatttacaccgtcccgaccaacttcaccctgtccgccaccgccgcttgcggcagcggctctgtgacccaggtggcgttttatgcgaatagcactttgattggaacgagcacgaccccgccgtaccttttcgactggaaaagcgtttcggctggaacactggctttgacggcggtggcctacacgaccgacccggccaataccgggttggcctcatcgccggtgacagtgacggtgaactggccgaccaatgtggggcaggttacgtttgcctcgactgaattgcaggttccagcggcagggctgcccatcacgatcaaccgtctttacgacacgcgctttgccaccaacggctccttcggttacaatgggaaattggattacgagcaggtcaacatccaaacatcaggcccgttgtccaccggctggctggggaagcgcagcgggttgacgtattacgtcgcagacaccgcgcagcatgttgtcacggtaagtcttagccccagcgaacaatattcatttattccgcaaattattttcgtcctgagcggaaccagcaccataaacgcctcccaggtgccgacctgctacaatgcctacaaggtcaagctggctttcatccccgttgggcaggggcagttgacggtgtccgggccttcgcccagcagggttggcatggatgacggcttgtccggctggacggtgcctctcaccgtgacccgatatgatagtttcggttttcccaccagcaactacgaacccgccttctcggatttcacgttcaccgcacccgatggcacgaaatacaattttgatggcaacggcaatctcagccagcacaccgaccgcaatggtaattacctgcaatacgggtatggcggaatcgttcattccagcgggaagcaggttttgtttgatcgcgacccgaccagcggcaatgtcacggcgatttacgaccccaactcgcaggatggtttcgggggcatcaccggccccgctgcggtgacgtatgggtatgacgcgctcggcaacctaaccaacgtaagccggttggtggatcgcgtggcgaccaattacaataccaccgcgtatgcctacacgaacgcaagtttttcaaacaatgttacggccatcaccgacccgcgcggcattgtcgcttcccgctatgaatatgacgcgagcggacggttgaccaagcagtatgacgcattcgggcactttaccattttcagctacgatacggtcactcatcgtcaggttgtggttgaccggctgggcaacacgacggtgcaaaattttactgcttccggcctgctcgccagcttgcaggacgcggcaggtggagtgactgcttacgcttacgaccaacaggggcgcaaaatcgcgcaaaccaatgcccttggacaggtcaccacctacagctacgacagcaacgataacgtgacgggcgtcaccacccccatcggtagttcttccagcgctacatataatagctttggtgagccgctggtggccattgacgatcttggcaacggcaccaccaatgtgtatgacgtcaatggcaatttgttgctggtgacgaatgcgctgaatatcgtgacggcttacggctatgacagccagggcaatacgatcaccgagaccaacgcgctcggtttgcccgaacaagtactcgttaccaacgcgtatgaccaatttggcaacctcaccaacaccacaacgctcaacgtgcagctttccgttcttaactcggtcggctacacgtatgatgccaatggcaacaagctgacgcaaaccacgacccgaacggcttccgggagcacgcaaactatattgatgcagtggaattacgacgccgccaatcgcataacggctacggtggatacgctgaacaacaccaacttcaccgtttataatggcatcggaaagcaagcgcaaaccgtggacgcccttaatcacaccaatctgctttattacgatgccaacggcttattgacaaacgccacctatgcggatggcctgtctgaaaccatcgcctacgatgccgagcaacgcatagtagccagcacggatctctgtgggcgagcgactacctacacttatgacgcggttggtcacctcatacagaccacttatcccgacggcagctatgttgccagtagctatgacttggcaggtcaattcaaatattccacgatgaccacaccatcagcaggaatgttaccgtcaacgacgatcaccaccgccaaatatggttacgattcggcagggcggcggattgcaatgactaatgccctctatcaagtgacgcgctttgcgtatgatgcgaatgggaaccagaccaatatcgttgacgctctgaaccacaccaattcgctggtgtatgacgcgctcaaccgtcaaagcgcgatgatctattccgatggcacgagggaaagctatggctttgacggccttgctcgaaagacagccgtcaccaatcaggcgggcatcgtcacgctgtttggctttgatgctcttggacacctgacagcggtaaccaacaattttggcggtgcggctcaggccgtcaccaaatatgtgtatgatgaagtcggcaatctggtccaacagatcgacgcgctcaatcacacgaatttgttcgattacgacaacctgggcaggcgcacgaaacaaactttgcctggaaatcagatttctttattcagctacgatgccgtgggtaatctgattcgggagaccaatttcaacggtgtggtcattaccaaccaatacgacgctctcaatcgcctcaccaacaaatcatctgcgggcggctataaaataacctttgcctattcaccaaccgggcagcgcacgaacatggtggatgccagtggcacgaacagttatacgtatgacagccgtggacgcttgctgaccaagatcacgccgcaaggaacgctgacctacacttacgacggctacggcaacttggcgacgattcaatcctcaactgctggcggcacgttactgtcgtatgggtatgatattttgaaccgattaacgaacgtcgtggatcgcttcaccaactcgacggtttacaatttcgacgttgttggaaatttgcagacggttcagttgcccaacaaagttacgaacagctacacgtacgacacgctcaaccggctcaccaatcttactgccaaatcaagcggcggcaccgtggcgagtttcgcttacaaactcgccttggctggcaaccgcacgaatttgaccgaggcattgaatggcgtgaatcgcaccaattcgtggagttatgacgcgcggtttcgtttgaccaacgagaccatcaccgcgtccgccgcgcccaccggcacgatcagcagcaagtatgacagtgctggaaaccggacgaaccgcacgagcagtgttgcaggagttggaagccaaactttcaatttcaacgccaatgaccaaatcagcacagatgtctatgacagcaacggaaacacacgaaccaacggcgcaaatgtgttcttttacgacgccgagaaccggttgaccaacgccacggtcgggggaacgaacatcactgtcatttatgatggtgatggcaaccgtgtccgcaaaatcatcggcacgaccaccaatttttatctcgtggacgacttcaatccgaccggctacgcccaagtgttggaggaaaagacgggcacgaatctgactcgcatctacacctacggcctcacccttatcagccagcgcgacaccgtgacccgcttctttggttacgacggaaatggcaacacccgctatctcaccgacacaagtgccgccatttccgatacgtatgtgtacgacgcctatggcgtcctggttgccaattcaggaaccagcacaaacttttatcgttattcaggtgaacagtttgacccaaatctgggactgtattatttgcgcgcccgttacatgaatcctgatacaggaagattctggacgcgggattcattcgagggcaacccggaagacccgaagtcgctgcaccgctacacctacggtgaaggcgaccctatcgataaccgtgatccaagtgggcacgatattggcggtgtcctgactgccatcaatataagcgggatgttggctgcaatgagctctcccgtaacgacgcgagcaagcgcaatcgtaggtggatcgggtagcgtgggaacgtcacggcctcttactcagggagaaatcacccttgctcaatcgatgtttggcgggaaaattgattacacgaaggtgaatatctatcacaaaaagcaaaacccactccatccaaaggaaaccttgataacgcctgatggaaatatctactccaacccgaagggaaacacctacagcactgactattctgcggcggctcttcccaacctctcgcttatagtaacgagcgagttgtttattcatgaaatgacacatgtctggcaatttcaaacgggtgtccatgtgatggcatcagcgctatacagaaaatacgagtacgattactcaaaattaggcacgataaagttcacagaatatggggtcgagcaacaagcaaccattgttgaagattattttcttcttaaaaatggctacacgaaaaacgacaagaatggcaaacctgtgcagatgccttcccttcaaacctaccagacagtcacgtcgccgtatttcccttaa

SEQ ID NO: 124 - DNA, 4059 bp, Pelobacter propionicus
atgaaacccgcaaaactcaacaacaccgtggtattcactattgtctttttcatttcaatctgcggcgtctgtttcgccgatccgctgaccattaccggccccgacgcgccgagcgatggctcacaatactctgcaacaggaggaagcgccccctattactggtgcattaccaaagggagcatcacccacaacggcgttgtgacggtatcgggccagtgtggcagcgcaacaatcaccgtttgggattccagcggagaaaccgcacgcaagacaataagaatggccggcacgtcacgatgggttcaaacggattacaagacgtgcccctcgttcacgtgcgcgggctccggatgcccatgcacggggggatgcagttgggtgtggggatgcatcttttcttcatactatcccgtcgagatcagcggcaacatcaaaaaggttggcagcgcttggacctgcgcttcatccaatgggagggggtgcctggtatggaccggccccccgccaccgggtgtgtcatgcagtggttcacaacttcagctggtcagctcgatcacgacgtatgaatggaaatgccaggatgggaccaacggcccggaatcttcctgttcatcacctccggttcccctcaaaaaacccaaagatctcggcgccggcaccgccaacgcgacctgcaccgagtccgccgccaacctgaagagcggcaactactaccactcccagagcatcgttgccaggcccgagagcctgagcctcgacctctcctacaacagcctcgaaaccggggacactcccctcggcagggggtggacccacagcttcaacctgagtctcgccacgaccagcagcggcctacgggtgaagcttgccgacggcgattttctcgacttcgtcctttccggcacaacctaccttcccgcatccaccagcactgacaccagcaacatcgttaaaacaaccgagggaagctacgtccggaccttcagggacggcctcacccagaccttcaatgcctcgggccagctcaccgccataagcgatgcgaacggcaacacgacgaccctggcttattcggggaacgatctcgcaaccgtcactgactccaccagccgcaacctcaccatcggctccagcgacggcaggatcattgccatccaggatccggccggcagaatgaccagctttgcctacagcggcaacctactgacctcggtaaccgacccggccggcaccagctggcggttcgtttatgacgaatacggcaggatgatccggaaaaccgatcccggcaacaacaccagcgaaaacggctatgacgccgccggcaggaacatcagcagcaccgatgccgaaggcaggacaaaaaccatcagctacaatgccacgggcagcagcagcgtcaccgagaaggacggcagcgtctggacccacgcctacgacccgaccctgaacgtccccacggcgacaaccgatcccttaggcaacaccgtacgacggagctacgacgccaagggcaacctgctgagcatcaccgatccggacggaaacacgacccgctacacttacgacgcggccaacaacccgctcaccgtgactgatcccctgggcaacacaaccagctacacctacgacagcctgggccgggtgctgacaatcaccgacccggatggccgcatcaccattaacagctacgatgaaagagggaacctgctgcggagcgtagatcccacggggggtgcctacctgttcgcctacgatgccgccggcaacctgacaagcgtaaccgacccgcgcggcaacagggtcggctacgtttatgacacctacaacactatcgccgcgatcaccgaccagaacggaaagactatccgcttcagccatgacatatcgggtaacctgctgaccatgaaggatccggacggcaagatcaccacctactcctacgatgcactgaaccgcctggtcgccatcaccgatcccctgggaaccaccacgaaattcacctacgacaacctgggtaaccgcaccgccgtaactgacgggaacggcaacctcaccagctacacctacaacttcagaaacaaaccgctgaccatcagggatgcgctcggcagcacgacaactcttgcctacggcggctgcggctcctgcggcggcgggggcaacgacaaacttacctccctcaccgacgccaacaacaacctgaccgggtacgagtacgaccagctcggacgccttgcccgcgagaccgaccctctcggcaatgtcaccggctacggctacgactcccgggacaacctcaccgccaggaccgacgccaacggcagcaccgctacctatgcctacgacgccaacaaccgcctgctcagaaaaacctacccagacgggagcgtggagagcttcagctacgacgccagaggtaatatcctcaccgccgcgaacaaacatatctcctacgccttcagctacgacgccaacaacaggatgctctcgtccaccggctccaacaatgggaccctgaagtacgaatacgacccggccggcaaccgtaccaccatggtcacccccgaaggtgagcggatcagctaccgctacgacgccgccaaccacctcaccgccatcgtctcgccccgggggaccttcgatatcacctacaacgacctgggcaggagaacgaaactcagctatcccaacggagcaaccataagctaccgctacgacaactccgaacggctggtgaaactggagcataaaacaaggcacggcaggacaatcgacagcttttcctataccctggaccgggtcggcaaccgcctgagcacaaccgaagccaacgcaaccaccaactacggctatgacgccatctatcgtctgctttacgcacagcagagccgtcgccacaacagcagagataacgaacagtacagctacgatcccgtcggcaaccgacttatcgggccccaccagcaaaccggctacagttatggaaccggcaaccagctgcttaagaacgatcaggcaagcttcacgtatgacaagaacggcaaccttgccgagcgaagcctggacaacgatcagcatggccaccacggccatcaaagtacgtcctggaagtacaccttcgattatgagaaccggctggtgaaagccgagaacggcgccgtcaacgtgagcttcgcctatgacccgttcggcaggagaatcgagaagaggaccgagatcaccggtcccggtgaacgcggtcatgacgtagaggaggggatcacccgttacctgtacgacgggatgaacctgattcgggagacccgagagaggcaccgccatgccggccgttccgagacgatcagctacctccatggcccgaacatcgacgagccactggcggccatgagtgaccacaggagttggtactaccatgccgacggcctgggaagcatcgtggcgcttacggacagacatggtaccgtggtacaggaatacaactacgacagcttcggcaaccctgatcagcggggagagaacatcgatcagccgttctcgtacacaggaagggagtgggaccgggagaccgggctgtactactaccgcgcacggtactatgatcccaaaatcggtaggttcatccaaaaggatccgatatcattcgctggcggggatgtgaacctttacgcttacgtcttaaataatccgattaatcgattagatccgttcggactttggaatagcaaaacatttcctacaaatatcagcaactatgccaatagtgcactatattggcctggatcaaaatatcaaccaatagggccttttggtaaaatttgtggcgcagaaggaactgttgaagcgacttggataccagatataacaccggaagcttgccgaaaacatgacgaatgttatgacaaatgtgcaaaaaaatgtgccggatatgattgtaaaaaaatatgtgactcgaaattgtttagatcaaatccaccgtatggaacagcaacaaaactatatggaaaggatgcatatgacgctgcaaaaagaaaatatggctgtaacaaatgcaattaa

SEQ ID NO: 125 - DNA, 8898 bp, Prevotella denticola
gtgagcaaatacttcgccggtacccttgccgattctttgtctgtaggccgtgcagaactcaaagtgccccgtggcagtatggagcgtgccaagattttgagcattacgccgcttcgcaagggtgagctgccccatttgcccgcaggcatggtcaacgtaacggcagacagaagccatcctaccgttgcaattaactcgaaagacagcatcgccggctaccgtttcctgccgcacggcgagcattttgtccattcgctcgcaagcatcaccgtgccttacgatagcacccttatcccgcaaggctatactgccgaagacatacacacctactactacgacgaactaaaagcccagtgggtgatgctacgacataaggctttggacaaaggccgagagttagtcatggccgagacctcgcactttaccgatgtcatcaacggtatcatcaaagtgcccgaaagccccgagacgcagaactacgtccccacgggcatcagtgaactcaaagctgccgccccgagtgccggcatcacagcagtgagtgcgcccactgctaatcaaagtggaacggcatcattaagctatccttttgaactgcccaaaggacgggcagacatgcaaccgagtgtcggcttgcaatacagcagcgacggcagttcgtcttatgtaggttatggttggagccttcctctgcaaagcatcgacatcgaaacccgctggggtgttccccgcttcgatgccgataaggaaagcgagagttacctactcatgggtagcaagctcaatgaccgcacctatcgcactaccgatgcacccgcgagaacgaaagacaaacgtttctatccgcttgtcgagggcggctttgccaagattatccgcaaaggcgacagtccgcagaactacatatgggaagtaacctctaaggacggcaccgtgtcttatttcggcggcgtagacggtatgatagacgaaggtgccgtcctcaaagacggcaatggaaacattctgcgctgggcactctgcaagacacaagatactcacggcaatttcatttcttacaaatacttcaaaaaaggaaataacctctatcccgatacctaccgctatacgggtagcaaagatggagagggagcttacagtgtacaattcgcctttaaatcagatgcgcgtaaggatgtcgtcaagagcggtcgattgggtgtgttgcaaaccgacgatgccttgctcgaccgcgtggaagtgaagtataacagcgagctactgcgcgcttatgcacttcattacaaggaaggtgtcttttccaagacgcttttggaaagcattgagcaattagacagtaaaaacaatcatgttgcgacacaaacgttcagttattataatgatataacaaaaagaattttctccgatacgcctgtaatttatacagcagagaaagacaattatggcaggcttgtcaaattctacatcgggaactttgacgaaagactttctcttctcggcggtggatctgccaaagggaacacagtaggtggcggtgtcatggtcggggccggctggggtccagcgtcggttaatgcgggtggttcttattcttacaccaagacgaacaacgaaggacgcatcgcccttgtagacatcaacggcgatggcatgcccgacaaggtgtggaaaggtgcggacggcaggttgcattatcgattgaaccaaaacaaagaccttcgccatccgtctttcggagacaaaatgacgataacgggtatcggcagttttacaggaggtaccaccaccagtaactcttggaacgcgaatgtcgctacgggctttggcccggcaagtatcggctatgccgtaaataagacgaccgaccagagcaaaagcaaaacctattttcaggatttcaatgccgacggtcttattgacatcgctcaaaatggtacggtctatttcaaccacagcaatggcaaggatgtaagtttcagtagtacgagtaccaatacgggaaatcctattacgggaaatgcggcaagcatagactctacattcattcctgactataaggctatccgtgattccttggaacgcgaattccccttgcacgatgccgttcgtttatggcgtgccccttacgcaggtacggtgaaagtgacaggagcggtcaacaaaccgtctgcccaaggtgacggtgttagtctgagtatgcaacataatgacatcgtgttatggaaagatacacttctgcaattcggtagtcttacggtaccaacgaagaccctttccgtccgtccaggtgactatctgctcttccgcgtgaatgcaagatgttctggcataggcgatgtcgtggaatgggaccccgacattgtttatacttccattgcggtagatgcctacgcaggtgaagatttgaaacattatcgcaattcgtcggattatgtgcctggcgaaatgtccactgcaccgcttgccattgatggcacggtcttctatgaaggaggttttaataagcagaaaacaagcgacgatgtcgtcctctctgtagtcaagacagataaaaccggtacacaaacggagataaaccgtcttcttctgccagctgatactgtgctcacagcaaagttcgagggcaatttccattcttccgttgtggacagtgctacggtaaacttcatcatcaagacgaacagccccatcaactggcagcatatcagctggacgcccgtattccatagtgatactaccaaatacacgcttgctccgcaacgcctgatgttcaataaaaatatcgtagctgcaaaggatacgcttatacatgtcgttgcaagcgattccacttggggtgacaggttggtcttcgtgcccgatctaaaggtaagccgttcttcagataaagatactgcgcccgccaccgtccatctcacgttgaaagacgaaacgggttcactgctttaccacaaggattacacgatggcggggaataaccaccttcaaggagacagtacggttgtgaacggtatctctcttattccacatctttcagcaaagaaaatacaagtgagtttttctgtcctcaacgaattggataatgcccccattgcacggctacatgttcttcgtgactctatactttacaaagtagggacagacggaaagaaacatgagtcaggacgtagactggtacgcgtagattccatttcggcctcggtgttctccagcttcaatcgttttgatcatggcccgctttataaaggttggggactatttgcatggaacggtaatgaaaagggagaacctatcaagattgatgagataagagcctctgaccataacgattatatcaaagatgggaaaatcgatgaagaagccgttgagaaaaatacactcgatatcaacaagcagaaattctttacgatggcatatagtcccacaacgggaaagtatgtcagcgccacagacagtgtgtatataaaagtcacaatgatgcgtgcatcacgattgggtgaagatgagattgttgttgattccatcaactataacctgaacggagaaggactttcagcacccgtgcagatgacagaatcgaaaagcaagggcaagacctactctttgggattttcgatgggagtcagtctcggagtaaataggagcaacaccaagcaagagtcttataccacggtgtccgcaatggatttgaacggtgacagttatcctgactggattcgtgaaaatgacggtaagatcagagtacagcttactcatcagatcggtacgctcggtgacgggcaagactatgatgtggagccctcaatgtcttatggagaatcggaaaacacaggtggggatgccggactcagtatggatcccaatagctataagcttcccaatttcaaagaacaacttagaaaagcaacagcctcttttgctaagagtgtggcaagcttgcaacaaaccaagcgactggataagaatgccgaaggggcgagctttagcggcaacgtctcggaaggagcttgcagtgccagcggtaatttctcaagcggaacatcagagtccgtacgtgactggggagaccttaacggagacggactgcccgatatgatatccaagggacaggtacgttataatctgggatattctttcaccaaggctatgccatcaggcatcaatgctgtcgaacatagttcaaataacaactatggtgacgggatgggcgtatgtatccccattctcggtctctttaatatttctgcaggacagaatgatacaggaagcctcacttccggtaagggagctttccatgacataaacggtgacggactgcccgactttgtcgaacaggacggcaatggtgatctgaaagtcactctgaatacgggcagtggctttgctacaccaaaagacctgcagaagaaatcggaactttccggtaatatgggctcttccgtagccatatacgccagcactgcctatacaatccgtatacccctaccgttcggctttgtcatcaatattacaccgagcatacaaggttcacatagcgaaagcatcaatcgcacgactgcggctttgatggatatagacggcgacggcttgccagatctcgtttacagcgatagcgaaaacagtatgaaggttcgtcgcaacctcaccggtcgcaccaacctgctcaaaggcgttaccctgcctttcggcggccacgttgccgtagaatacaagcagacagaaccaagctataacatgcctggtcgccgttgggtgatggcatccgtggagaccacgggcggctatgccgagaacggagccaccaggatgcgcaacgagttcgaatatgaaggcggctaccgcgatcgtcgagaacgcgacttctacggttttgagaaggtcatcaccaaacagattgacacgcagaatggtaatgccgtttaccgcaagcaggtagcagagtatggccatcatcgtgatttctacatgcacgacctcatcacttccgagaccctttatgatgcagccggccataaactgcaggaaacagagaacaaatacacgctgacggcacaggcgaaaaccgatgttttcttccccgcactcgtctctgtaaagcagactatttacgacaacaacggctcgggcagcatgagcaccaccatgcacaatacttacgacgcttacggcaacctcgcctcttacaaggaaacggcaacgaactatgagctggatgccgatataacctatcatgacttgcaggcaaaatatatcgtctccgtgcccaaacatatcgccgtaaaggataaaggaggaaaagtttaccgcgaacgttctacgcaaatcaatggtaatggcgacatcaccagcatcacgatgcacaacggcacaaagccgtcggtctacgatatgacctacgatgcctatggtaatcttgcaagtctcaccaagcccgagaaccataagggacagcgcatgcgctacgactacacttatgacgatgtgctacacatgttcgttacgaacgtaaaagacgcctacggttacacctcttccaccgtctacgactacaagtgggcagtgcccttagagacttccgacctcaacggcaacaaaatgcgctatacctatgacggcatggggcgcccatcaaccatccttgcccccaaggaattggagtcgggcaggccctatacgctgaaattcgaataccattcggcagagcgttacgcccgaactctgcattactcccccgagggcgacattgagacctatacctttgccgacagcctgatgcgcgccgtgcagaccaagcagacgggcgtagtatggacaggcggaggcaatcaaaaggtttccattgtcagcggacgtgccgttgtcgatgccttcggccgcaccatcaaggcgttctatcccaccacggagagctacggcagcatcggtacgtataacaccgccacgggcgacccgcaggcaaccaccgaattcgacgtctacgaccgcacgacaaaggttgtgctgcccgatggggcaaccactacgacggcctacggcatcgtctcccatgacggtgagccgatgcttgaaacaaaggtgaccgatgccctcggacgcaatgccgagagttacaccgacgagaaaggacgtaatcgtgaaacagtacaacacgcctcgggcgacaacatcgccgtgaagtacgactacgatgccgtgggacaagtgactaccgttcatcatcccaacgacaagaccacaacctacgagtacgacctcttgggacacaagctcaaagtgaaccatcccgatgcaggcgaagtgacctgcacctacgacgcggcaggtaacctcctgaccaaacttacggcggaactcaaaaagaggatttcggctgatgcacccatcacttacacctatgactacgaacggttaagcgaggtgctctatcccaagaacctctttaaccgcgttacctacacctatggcaaaccgggagaaaagtataaccgtgcaggcagacttgtgctcgtggaagacgcttcgggtggtgaagcttattactacggcaaccaaggcgaggtcgtaaagaccgttcgctcggtgatggtcagcaccgccgacgtacgcacctacatctatggtgccacctacgacagctggaaccgtgtgcgcacgatgacttaccctgacggagaagtcgtgacctatgcctataatgctgcaggacaaatcgcgagtgtcaaatccaacaaacaaggaaaggaagagactatcgttgaaaaggtgggctatgacaaggacggacacaccatctacaccaagttgggtaacggcatagagactacctacacctacgacaaacaacgcgaacgcttgcaagaaatgaatctcacgacggtgggaacatccatcatgcacaacaaatatcagtatgatgcggtggataatatcttaggaatcaccaatgccgtagacccgacgcggggcaatactaatggcgataaaaagcttggtggcgcattcaagcatagctatgcttacgacgatttaaaccgtttggtatatgcaagtggtaaggccaagcaggcaagttacagcatgcagatgacctttggacgaatgagtgaaccgcttaccaagatacagaaagtagattctacaaagacggcacagtcttacgacttcacctataagtacgaggacagcaaccaccccacagcccccacgcagatagggcatgagcattacacctatgatgccaacggaaatcccacattggtggagaacgacagtctcaataccgaacggagaatgtattgggatgaggataaccgactgatggtgttgtcggataatggcaagaccagccgatacacctacaatgccgccggcgagcgtatcatcaagagccacggtgacctcgagggtgtgtatgtcaacggcgcaccacagggaatcacgttccacgagacggaggattacacgatttatcctgctccgattatcactgtaacaaagaaccgctttaccaagcattacttcatcggcgataaacgtgtagcaagtaaactcggtgtaggcaagttcagcaatgtctatggcatcagcggcaacaacgttacggcaggtcagaaagactatgccgctcgcatgatgcagatagagaagcagcgtgaggagtattacaagtcgcgcgaaacgccaccgggtattcctacgatgaagggtgcaacagcagaccctgacaacacccatcgtggttataacgacattattggagatttgggcgaccactccgtacccgaaggttgggtgcaacggccgaagttcaatgaaaaaggagatgttcccgggccgcccatccaatggcagaagcccgaagacccagataatgcccagcctggctatggttatatcccaacggataccaccaacaccgaggaaatcttcttctatcatagtgaccacctcggcagcacctcttatatcaccgatgccaaggctaacatcacccaattcgatgcttacctgccttatggagaattgctcgtggatgaacacaacagcagcgaggatatgccgtataagttcaacggtaaggaactcgaccaagaaactggcttgtactactatgggacaaggtatatgaaccctgtgacgagtctgtggtatggagtggatagatttgctgaaaaataccctcagctttctgcttacaatatttgtgcaaataatccaatgaatacaatagattttcatggagatagtataacagcagtcttaattacaaatggaacagcagggatagaaaggattaagtatagttatagtgcaggtgaaaatggagaatatggtttccgaaatagtaatggagaactatattctggtacagataattttataaattcattaacatctgcattaaacgaattacgaacgggaggagatgtaggaaatgctttagtttctgaacttataaactcaactaatagcgttgagattgctcaaggaaaagcaaatagagcagatgtaaaaggaacttatatattatggaatccaaatttaacaacaggtggtttaaatgaatatggcacagaatatagaccagcttacattggattaggtcatgaaatggcgcatattcaagatacatggaggggaactatagatcaaagcacatgggttacagttaacggaatcaatattccaaactctgaaaaatattcaactcacattgaaaatcaattgagagcagagcacaatatcccccttcgaactcattatggtatagatgctagttctggacaacgaaaaggattagaaagtactcgaataatttggaacagatttagcatgttctacaacagaaaagttaaagtaaacgcatattttagcgtttctactcctttttattattag

SEQ ID NO: 126 - DNA, 9234 bp, Prevotella denticola
atgaagtattctacacattcactcctccttccgttcctgctgctcgcaggaaccgtcctgaactcctgtaatggcggcagccggccggcagggcaggctgatgtcactacggacacggcttcttccgtgcggggagactgtacttcccgacaggctgcccccttgcggaaacaggtcaaggacagcatccaaggctcatccgtgaagagtagctccaagggcgtagtacgaaacgacaaggagaatcgtgtagacacgcacaagctggacaggaaatctgcaagactttttgcagacttaggcagacgtaccgtcagcaagttctttaccaactccgacagcgacacgctcaatgtcgggcgtgcccagcttggcgtaccacgtgaggctatggaaaagggtaaagttcttagtattacaccacttagaaaaggtgaactaccaaccttgcctacgggtatggtgaacgttacaggtagttgtgatacattgatggcaagaacagatacggtgtctggttatcgcttcttacctcatggcaatcatttcgtccatcatctggcaagtatcgcagtaccttacgacagcacgttgataccgaaaggctatactgtagatgatatccacacctattactatgatgaactgcaccaacgctggacaatgctccagtcaaaaggtattgataccaagcgtgaggtggcaatggcagagacttcacactttacggatgtcatcaacggtatcatcaaggttccagagagtcccgaaacacagaactatgtccctacaggcatcagtgagctgaaggctgctgacccagcagcgggtattcagcagattgaagccccatcagctaatcagaacggtacggcaacactgtcctatcctttcgaagttcctgcaggacgtaatgatattggtgtaagtgccggcttacagtacagcagcgagggcggcagcagctttgcaggctatgggtggagccttcccgtgcagagcattgacatcgagacccgctggggtgtgccgcgcttcgacagccggtatgagagcgagagttacctgctcatgggacagcagctcagcgaccggctctaccgcaggaccgactctttgtcacgtcagactgataagcagttctatccaatgactgaaggcgggttcagtaggattatccgaaagggtaacagcccgaagaactattactgggaagtgactggcaaggacggtacagtctacagttacggcggacacggcggacatgccagtgacgccacgtctcttgccgacaccaagggcaaccgtatcagatgggcgcttgaccgtgttaccgatgttcacggaaactttgccgctttccattacatgaaatctggcaataacctttatccggaacgctatacatggacaggattcggggagacggaaggactgtatagtattgaattcaactggaatactggtaacgtacacagagttgactatgttcgtagtggtagacttggggttctccaaacagactctcttctgttgggaagcgtcgaggtcaaaaacaatgggcagcagcttcgttcatatacaatccattatgaaaaaggacccttcgggaaaacacttcttaagagcattgaccagaacgacagtaaaggtatagtagtagctgcacagagtttcaactactataatgatgtgaaaaagggactctatgcagatagtattacaacctatacagctggtatagacaattatggcaagcttgtaaaaaccaaaattggacatttcgacgaacacttgtctcttcttggcggagcttcctccaagggaaataccattggaggtggtataatggttggtgctggctgggggccggcaacagcgagtgcaggtgcttcttatagccataccaattcttccaatgaaggccgtgtgacacttgtagatatcaatggcgatgggatgcccgataaggtatggaaaggtagcgatggtaaactccattatcgcctcaatatgaacaaggccctctctcatcctgtctttggtaaagaacaggctttggtgggtgtaaacagtttctcttccggcaaggctaccagctatactctcagtgctaacgttgctacaggttttggaccggcgaatatgggctatgccatcagcaaaactaaggatcagaataagaccaaggtttatttccaggattttaatagtgatggccttgttgatattgcagttaacggaatcgtttatttcaaccatagcgacggaaaagatgtgacctttgcacctgccagtacggccaccggcaacccaataccatcaatagccggagttaacgttgcgcctgctttcaaagttgactacaagactgttcgcgactctttggagagagagttccctctacatgatgtcgtacgtgtttggcgagcgccttattcaggtacagtatctgttatgagccatgtagagaagcactctcctgagggagatggtgtcagcctcagtatgcaattcaacagtgacgtgttatggaaggataccctgttacaatcgggatctgtgaccttacctgcaataacccgtagcgtaaaacctggagatgttttcgtatttcgtgtcggagcacgttactccggtataggtgatgatgtcatatgggatccggagataacttatacttctatcaagactgataaatatgccggtgaggacttgaagagatatcgcagcagtgaagattatataagcggtgcatattcaacagctgccctttcggaaactgcagtaaacagatttgaaggtacattcaataaacagaagacttctgatgacattatactggcaatcataaagactgataaggatggcaatcagttggtcatggacagtctcctccttaaagcagatactgtgatcagccatggcagcttctccggtaatctaacagccacagcaggagaagaggctactgttaatttcattatacgtactgcaagccccatcaactggaaacatatagactggagacctgtcttttatgcagacaccatgaaatatgttctttccccgcaatgcctgatgttcagcaagaatatttctctatgtccagataccgttataggcagaaatgtctctatacaaggtccggtatggggaaaagcacttactcttgtccctgagctttctgtccaaaggacatcaaacaaggatacggcgccggcaacggtctatatgactatcaaggatgatcatggatccttactctaccgcaaagaattaactctcggcagcagtaatcagctgacaggatcaactatcagagttgcagacggttctgtacttgcacagaagatgtctgcaggaaaaatacaggtgacatattctatcttgaacgaacttgaaaacgcgactgcaaagctaaagatatttagggattctgttgtcagccctgctacagcaggaagccctgcagtgttaagacctgtcagggtttccacagtcaatgcgtctgtctattcaagctttaaccgttttgactatggacagctgtacaaaggttggggatcttttgcatggaatggtacggcaaagaatgttgcaataccgaaggacaagatgaagattcctgagacaaatgagtactatcatgatgggaaagtcaatgagagtgccgtagaagccaatgagatggatattaaccgtcaactgttctttacactgtcttacttaccagagaaaaaatactttgtgagtgcaacagatagtgcctatgtcggttctgttgtcatgcgtccatcacgactgggagaggatgatatcattgtggatactgtcgattataatatacaaggtggaggactggcagcaccggtgttactgacagagtcgaaatcaaagggtaagacatataatatgggattctcattgggagccagcctcggagtcaacaagagtaatacctcacagcagtcctataatattatctccgccatggacctcaatggtgacggttaccctgactggttgaatgacaatgatgggaaagtcgttgcacaactgacacagcctacaggtatactgggcaaggggagcctgcaatatgatgttgaaaatgccgctacagatggtgacgccagcaatataggtggagatattggcttatcttcagataagagtgcctattcctttaaagacttcaaggagaagatggctgtcgcaaaggccgcctttgcacagcatacaaccacaaagcagattatgaagcagcgggctgcagaggggaattctgccagtcactctggtaaagtagcagaattttcttgtggagcaagtggaaacttctccagtggaacttcggaaacagtaagaggttgggaggatcttaatggagatggacttcctgatatggttaccgacggcaccgttcgttatggacttggctatgactttacaccagcgacagcctcttctcttacacaacttgagtcgactaaaaacagcaactttggtgacggacttggtatcacggttcccgtattgggactttttagtgtcaatatcggtcagaatgatacggagagcttgacctctacgcgttctcagctcagtgatgtcaatggtgacggtctccctgatctccttcaactggatgaaaagggcaatctgaaggctactttgaatactggaagcggatttatgtctggcagtacttctctcggacagagtaatatttctgacaaccttggttcctctgttgctgtctatgccagcacagcctatacctatacgatccctcttcccttcggtttcacaattagcattacaccaagtgtacagggatctcatagcgaaagcataagccgtactacggctgcagttatggatatggatggagacgggcttcctgatcttgtctatagtgacagcgaaaatcatctctatgtacgtcgtaaccttacgggcagaacgaacctgctgcgctccgtgacgcttcctttcggcggacatatccatatcgggtatgagcagacaactccaagttacgatttgccgggacgtcgctgggtgatgtcatcggttgagactacgggtggatacaaggagaacggagcaatacgaagcaggaatacctttgaatacagcggtggctaccgtgatcgtcgtgagcgtgacttctatggtttcaagcaggtgcgtaccaatcagatagataccgagaacggtgacagactctatcgttactccgtacagacctatggtaagaacagggattactatgctcatggactggttacgagtgagtatctctataccgctgatggaaagaagctgcagggatctctatatgactacgacctgaagacacttgccgcaggcagcaacacggccgacgctgttgtcttccccgccctgaagacgctcgttcagagtaactttgatgcagccaatggggacagcctggcggtcaccgtcagcaatacctacgatgactatggtaacctgcagggatataaggagacgacaactggctatagcttagaggcagacatcaactatcataagatagccgacaagtatatcgtcagtgtcccgagccatatcactgtcagcagtggcggcaggacttaccgtgaacgcagcacgaaggtggacggcaacggtgagataacggagatcatgcttcataacggtgacaaaccttctgtctacaacatgacttacgacggctatggcaacatcacacgcatgacgaagccggagaactacaatcatcagcgcatgttctatgcttatacgtatgacgaccgctatcatagtcttgtgacaagtgtcaaggatgcatacggttatagctccagcacggcttatgatggtctttggaatgctccgtctgtaacgactgaccttaacgggcagaagatggaatacacttacgatgcactgggcagacagcagacaatccgtgctccgtatgagatagagagcggtcagccgtttactatccgttttgagtacttccctgcagaacgtaaggcacataccatccattattctaaggaaggtaacatagatacctatacctttgccgactcgctgatgcgtgccgtccagacaaagcagacgggtgtagtgtggtctggtggaagcaatcaaaaagtctctatcgtcagtggaagggctgttatcgatgcttttggacgtaatattgcggcttattatccaatgacggagagctatggtaatattggtacttacaaccatgctacaggtgatttgcaggcaaagacagagtatgatgcgcacgaccgtaccatgagtgttacgcttgctgatggcagtgtgacacgcacagcctacagtatcggtagtcatgacggtgaaccaatgctccagacaacggtcacggatgcactgggacgacatgcggagagctatacggatgccaaggggcgcaaccgtgagacggtgcagcatgctcgtggtgaggatatcacggtgaagtacagctatgaccctgttggacaggtgatgacggttcagcatcctaacggcagggagacgaagtatgcctacgacctacttggtcgcaaactgatggtgaaccatcctgatgctggtgaaacggatatgacctatgatgcggcaggtaacctcctgacgaaactcacggcagagcttaggaagtcgatatctgacaagggttacatctcttacacctacgacttcgagcgactccatgaggtactttatccagaaaatctctttaatcgtgttacttatacctatggtaaagctggcgataagtataatcgcgctggtcgtcttgccctcgttgaggatgcgagtggcggtgaagcctactactacggtcgtcagggtgaggtgacgaagaccgtccgtacagtcatggcgagtgtggcggatattaggacttatgtctatggtgctacgtatgatagctggaaccgtgtgcagacgatgacttatcctgatggtgaagtggtgacctaccattataatgctgctggacaggttgagcgtcttacgagcaataaacagggacggcagagcgttattgttgataggataggttacgataaggagggtcatacggtctatacgaaactcggtaacggcacggagacaacctatacctacgacaagcagcgtgaacgtctgcagatgatgaatcttacagcggacggtcagactgtgatggagaacaggtatcgttatgatgccgtggacaacatcctcggcatcacgaatgccgccgacccgacgtcgctgacgaagctcaacagggcgaagctgggaggaaggagtgcgcatacgtatgagtacgatgagctgaaccgtcttgtccacgcaagcggcagggccaagcgtgcatcgtatgacatggtgatgtcgttcggacggatgagtgaaccgctcactaaggtgcagaaggtagactcaacgacaacagctaagtcttatgacttcgcttataagtatgaggacagtaaccacccgacagctccaacgcagattggtcacgaccattacacctatgatgccaacggtaatcctgtgctggtgacaaatgacagcaccaacaccacgagggagatgtactgggatgaggacaaccgtctcatggttttaagcgataatggcaaaacctcacgctatacgtataatgcagccggtgaacgtatcatgaagagctacggcacgatggagggtgtgtacatcaacggtgctccgcagggcatcaccttccacgagacggacaacttcacgctttatcctgcttcgataatcagcatcaacaagaaccgcttcacaaagcattactttattggtgacaaacgagttgcttcaaggataggaacgggtctgttcaataacgtctatggacgtaacggctcttacgttactgctggtcagcaggattatgctgaacgtatgaaccaaatccaacgtcagaaggaagcgtattacaagcagcagggcattgcacctggtgtacctacaatgaagggtgcgtatggcgatccggagaatacaaaacgaggatataactctatcattgatacactcggtaaccacgatgtaccgcaaggctggattcagactccacatcctaacacgaccacaggcaccaaccccggtcctcctataagctggaatgacccgagtaaccctgatgatccgcaggctggttatggctacatccctaatgacactacacgtgaagaaaccttcttctatcacagtgaccacttgggttcaacatcttacataacagatgaccacgctaacattacccagtatgatgcttacctgccatacggagagttattagttgacgaacacagcagctctgaagacctgccgtataagttcaatggcaaacagttcgataacgaaactggcttgtattattacggtgcaaggtatatgaaccctgtggcaagtatttggtatggggtggatgttttccaagagaataaagcagacgttgcttcttatctatattgcttcggcaatcccattaatctaacagatccagatggaaactgggagcgtgatagacatggtaatttgatagcccagaaaggtgataatgccgtgacttatgcgaagtatacaggaatatcaaataaagaatctcttaaaattttgttagcaaatggtatcacaattaattctaaaggagtgctaagtctaaaagttggcgatgttattaaaaataatggtttttcaagatctcagaatattttgaagaatgaatcaacaggcaatgatattccaaataattctaatcaaacattgacatatgggaaatataaatttaatataaatgcagctgtaagaacattaaataaaaatgcaaattcccattctcttggtaagtgtgcaaaatatgtcagacttgccctggaaggtggaggttttaatactgccggacaccctgtagatgcaaagaattataatcactttcttagagtaagagggtggcaagttgtgagtaccagtcaaggctttcaacctctaaaaggtgatattgctgtctttagagattttcaaggggacaaaaggtatcattcagctggccatattcaaatgtttaatggcaataggtggatctccgatttcagacaaaatggattttgggcaggaggcgattatagacgtcaccaaccctcatttgtgatattaaggttcggtagaaaagagtaa

SEQ ID NO: 127 - DNA, 9174 bp, Prevotella pallens
atgaagtattctacacattcactcctccttcctttcctgttgcttgcaggaatcatactaaactcctgtaatggtggaagtagtcgttctgctaaagaaactgtaatcagtgattctacatctactgatacagtctcttctgtacaaaaagatagcatttcccgaaaggctacttctttacatacacaagttaaggacagtgtacagaactcttctgtgaagagattctccaaagaagttgtaagaaatcaaaaggggaatcgtgtagatactcacaagccgaacaggaaatctgcaagactttttgcagacttagacaaacgtaccgtcagcaagttctttgctaactccgacagcgatacactcaatgttggacgtgctcagcttgccgttccacgtgaggctatggaaaagggtaaagttctcagtattactccacttagaaagggtgaactaccaaccttacctacgggtatggtgaacgttacaggtggctgtgacaccttaatggcaagaaccgatacggtgtcaggttatcgtttcttacctcatggcaatcactttgtccatcatctggcaagtatttctgtaccttatgacagcacgttgataccgaatggctatactgtagatgatatccacacctattattatgatgaactgcaccaacgctggacaatgctccagtcgaaaggtattgataccaagcgtgaggtggcaatggcagagacttcacattttacggatgtcatcaacggtatcatcaaagttccagagagtcccgaaacacagaactatgtccctacaggtatcagtgagctgaaggctgctgacccagcagcaggtattcaacagattgaagccccatcagctaatcagaatggtacggcaacactgtcctatcctttcgaagttcctgcagggcgtaatgatattggtgtaagtgccggcttacagtacagcagtgagggaggcagtagctttgttggctatggatggagccttcctgtacagagcattgacatagagacccgatggggtgtaccacgtttcgaagatcagtacgaaagtgagagctatctcctcatgggacagcagcttagtgaccgactctatcgtaggactgattctctggcaagacaagctgataagcagttctatccaatgactgaaggtggtttcagtaggattatccgaaagggtaacagcccgaagaactattactgggaagtgactggtaaggatggtacagtctatagttatggtggtcatggtggtcatgtaagtgatgctacttctcttaccgacaccaaagggaaccgtatcaaatgggcacttgatcgtgttaccgatgtccacgggaactttgccgctttccattatatgaagtctggcaataacctttatcctgaacgctatacatggacaggattcggggagacggaaggattgtatagcattgagttcgatattgactctacagccacagaccgaaaagatgtgacgagtagcggaagacttggcattatgcaaaaggacaaggggctactccgtaaggtcatagtgaagaataatggtcagcagctccgcagctataccttaaactatgaagaaggaccgtttggcaagatactgctaaagagcattgatcagaacgatagtagggatggtaaggttgctacacaatcttttgactattacaatgacctcaaaaatggacttttctcttctaaggcagaattatggaaggccgaaggagaagattacgaggcattcctcagccattcggttcgtgggtgtgatgacaatctaagtcttcttggtggtggagcttcaaaaagccacactacgggttggggaacaatggtaggtattggcttcgctgctggaacagtaaatgttggtccatctttctctaatagtaagagttcaaattcgggtaaagttgcttttgtagatattgatggtgacggactacccgataaactcttcaaacgaggtaaccaacttttctatcgtaagaacatgagcgcagatggaaagaatttactctttggaaaaactatattggtatcaggggtaaactctttctctgatggaaatagtaccactcactcttttaatgctgatgcagctgttgaagttggtatttcaagtaaacttaaagcctctgctggaatttcttatacacattcaaaagaacaagacaagacaaccacctatctttatgatttcaacagtgatggacttacagacatagctatcaatggtcaggtctatttcaatcatattgtagatggtaaacctgtatttagtcctgcaagtaatgtgacagccaatcctattattggtgaaggagcacctattgataagcattttattccagactataaggttatccgtgactccctggaaaaggaatatcccctgaatgatgccgtccggatgtggtgcgcaccttttgctggcaaggtcaacatacaaagtactataaaaaaacttagcaatcaaggtgatggtatcatctacagcattcaacatgagagtgatggcttcatggtccgcgactctttattacaagctggtagcaaaaccaacaatcttaattgtgatgtaaaagtaggagacagaattttcttccgtcttcagtcccgatatgatggtgaggatgataaggtcctttggaatcctataattacttatgtctctttacctgttggcaaggatcggtatctgtcagaagacttaaaaacatataatagcaagactgattatatagagggtgaaaacaatgttgctatatttaatcgtactggtaaggttacgcttcacgctccttatatgaaggggaagacttctgatgatgttacacttatcgtcacacgattagatcatcatggtgaaacaattgtaaaacgacttaaacttcctgctgatagtgtagtcaatggctcctacgattatactgataacataaatgagaaagattctgtttcattcttctttgaaatcacaaccacatccccagttgattggacaaaagtacaatgggcgggtagctataattatgaagatgaccaagaaagtgtacgttttgtagcatctcgtaggatgttcaacaagcctgttagtataacagggagcaaagtgttgaaacaaggtgttaccgtattaaataggaaataccgtcctaaacttttcattgttccaacactatctgttgtgcgtgaagataaaaagaatgacacagatactgctactgtttacctgactttacatgatcaaaacggacttcccgtattgcatcacacctgtcgtctgaatacttccaatacgctcaagggagatactatcgtagttacagacacaacacttatcaaacgattaaatacaggtaaggtaactgctacttttgccataagtaatgaattagctaaatctacttatgccaaagttagtttcttacgtgatagcctttcttaccaaagtgccacatccacagttgttactgccgtgcagcgtgttcttgtggatacgttagaggcttgtgtattctctgggtataactctgttgattatggaaggctctaccgaggatggggacaattcgcctataatggcaataaagcctatgccacccagccaatagaagtatcagcactgaccattgacagggataaatataaggatatagcagagcattataaatccacacatgatggcaatcaacttgcaaagagtcttactcctgtcaatgaacagcgtttctttgttatgggatatgatgcaaataagaggatgtatgttggtggatcagagcatgtatttatctctttagatacaatctgtagttctcgtatcggcgaggatgctattataattgacagtgttcattatgctaaaaatgcgggcgaattgtctgcacctgtacttatgagtgagtcaaagagtaatggctatggtgtaagcggtggagtttcttatgcaggactcagtggcagtaagagtacacagacttcttatagcaaggtggctctaatggatatcaatggtaatggttatcctgattggttagaggaggtagatggcaatattgttactcaatataccaatgcaactggtacacttggggcaggtcgcatgcaattaaatgtcaatcgaccaaaatttaaagcaagttcttctactataggagcagatgcaagtctatcaaaacgggcttcggcaaagaacgctttagctatcagtatcaatcctaaaccacaagacgatgaaactcaaagtggaggtgaaggtaggaattcttccaatggtaatgctatctccagtgtgtctgtgagtgcaagtgggaactttacttctggaacctctcatacagaaagtgattggactgaccttaatggtgacggacttcctgatatgctctttggtgataaagtgaagtttggtcttggatatgactttacaaatgaagagaatagcggtgttacgtcattggagtcttctgaaaatagcacatggggtgcaggacttggtacatccatcgaggtacttggtaatgccgatatatcctttggcgtcaatggaacgaagacaacaacaaagtacaatgtgtcttttatagatgttaatggcgatggcttacctgatatggtaactcgtaatgctgacaagttcaccataatgctgaatacgggttctggatttattccttattcagaagaacaacagggtcgtttcaatgagtcattggcaacgtccgtttctcaatatggtaattttgctgtttccattccaatacatattctgtttttaaaactaaggtttacagctaaggttaccaaatcttggtcaagtggagttagccgtacgagtgctgccttaagggatatagatggcgatggaagacctgatcttatcatatctgacggaggaaagcagcttattgtctaccgcaaccttacgggaagaacgaacctgctgcgctctgtgacgcttcctttcggcggacatatcaatatcaactatgagcagacaactccaagttacgacatgccgggacgtcgctgggtgatgtcatcggttgagacgacaggtggatacaaggagaacggagcggtacgaagcaggaatacctttgaatatagcggtggctatcgtgaccgtcgtgagcgtgacttctatggtttcaagcaggtacgtactaatcagatagacactgagaatggtgatagactctatcgttactccgtacagacctatggtaagaacagggattactatgcacatgaacttgttacgagtgaatatctctataccgctgatggaaagaaactgcagggaactgtctatgactacgacctgaagacactcgccgttggtcataatacgacagatgctgttgtcttccctgccctaaagacgcttgttcagagtaactttgatgaagccagtggagacagtctttcggttgctgtcagcaatacttacgatgactatggtaacctacagggatataaggagacgacaacgggctatagcttagaggcaaacatcaactatcataagattgccgataagtatatcgttggtgttccaagtcatatcactgtcagcagtggcggtaagacttaccgtgaacgcagcacgaaggtggacggcaacggtgagataacggagatcatactccataacggtgacaagccatcagtctataacatgacttacgatggctatggtaacatcacacgcatgacgaagccggagaactataatcatcagcgtatgttctatgcttatacgtatgacgaccgctatcacagtcttgtgacaagtgtcaaggatgcatatggctatagctccagcacggcttatgatggtctttggaatgctccgtctgtaacgaccgacctcaacgggcagaagatggaatacacctacgatgccttaggacgtcagcagacgattcgtgctccgtatgagatagaaagcggtcagccgtttactatccgttttgagtacttccctgcagagcgtaaggcacataccatccattattctaaggatggaaatattgacacttatacctttgccgactcgctgatgcgtgccgtccagacgaagcagacgggtgtggtttggtctggtggcagcaatcaaaaggtctctatcgtcagtggaagagctgtcatcgatgccttcggtcgtaacattacagcttattacccaatgacggagagctatggtaacatcggcacttacaaccatgcgacgggtgatctgcaggcaaagacggagtatgatacgcacgatcgtaccacgagtgtgacgcttgctgacggcagtgtgacacgcacggcttatactatcggcagccatgacggtgaaccgatgcttcagacaatggtcacggatgctctgggacgacatgcggagagctataccgatgccaagggacgcaaccgtgagacggtgcagcatgcccgtggtgaggatatcacggtgaagtacaactatgaccctgtcggacaggtgctgacggttcagcatcctaacggtaaggagacgaagtattcctacgacttgcttggtcggaaactgatggtgaatcatcctgatgcaggtgagacggatatgacctatgatgcggcaggtaacctcctgacgaagctcacggcagaacttaggaagtcgatatctgacaagggttacatctcttacacctacgacttcgaacggcttcatgaggtgctttatcctgaaaatctcttcaaccgtgttacttatacctatggtaaagctggcgataagtataaccgcgctggtcgtcttgccctcgtagaggatgcgagtggcggtgaagcgtattactacggcagacagggtgaggtgacaaagactgtccgtacggtcatggcgagcgtggcggatatcaggacttatgtctatggtgctacgtatgatagctggaaccgtgtgcagacgatgacttatcctgatggtgaagtggtgacctaccattataatgcagctggacaggttgagcgtcttacgagcaataaacaaggacgtcagagcgttattgttgacaggataggttacgataaggagggtcatacggtttatacgaaactcggtaatggcacggagactacctatacctatgacaagcagcgtgaacgtctgcaggtgatgaaccttacagcggacggtcagactgtgatggaaaacaggtatcgctatgatgctgtggacaatatcctcggtattacgaatgccgccaacccaacgtcactgacgaaactcaacaaggcgaagctgggaggaaggagttcgcatacgtatgaatatgacgagctgaaccgccttattcatgcaagcggtaaagcaaagcgtgcatcgtatgatatggtgatgtcgttcggacggatgagtgagccactgaccaaggtacagaaggtggactcaacgacaactgctaagtcttataactttgcttataagtatgaggacagtaatcatccgacggctccaacgcagattggtcacgaccattacacatacgatgctaatggtaatccaacgctggtaacgaacgactctacgaatactacccgtgagatgtactgggatgaagacaaccgtctgatggtactctctgataatggcaagacgagtcgttacacttacaatgctgctggtgaacgcatcatgaagagttacggtacgatggaaggtgtgtatatcaatggtgcaccacagggtattaccttccacgagacggacaacttcacgctttatcctgcaagtatcctctctgttaacaagaatagattcacgaagcattacttcattggtgacaaacgaatcgcttcaaggataggaacgggtatgtttaacaacgtttatggacacaacggttcatacgtaacggctggtcagcaggactatgcagaacgtatgaatcagattcagacacagaaagaggcgtattataagaaggtgggtgtagcccctggtgtaccaacagagaagggtgcgtatggtgatccggagaacacgggtgttggttataatgccgtcctcactgaactcggtaaccatgatgtgccacagggttggattcagactccacgccacaatactacaccgaataccaatcctggtccacctgtaagctggaacgacccaagcaaccctgatgacccgcaggctggttatggctatattccaaacgacacaacacgtgaggagaccttcttctatcatagtgaccacctcggctcaacgtcttacatcacagacgaccataccaacattacacagtatgatgcctacctcccgtatggtgaactacttgtcgatgagcatagtagtagcgaggacatgccgtataagttcaatggcaaggaacttgacgaagaaacggggctgtactattacggagccaggtacatggaccccaaaatctccatgtggttgggggtagacccattaatggaaaagtatacaaatgtcagtggatatgttttttgtcatagtaatccaatagttagaattgatcgtgatggatgtgcagattattttagcattagtggcaagttcattagatcggataaatcaaaagataaaaatatctacataagaacttcttctggtaacgttttattatctaaatataatttcaagagaaatttacgtgctatgatgcgtattacgtatcattatgctaaggaagttgggttagaaggtaaggctaagtctattggtgtaaaatcaatgaagtcgaatcctgagggagaattagcgataacaacatatgataataggataagagtctctactgttaatgggcattttaaaaaatcaatggaccaaatatataatttcagaagtacattagcacatgaaggctttcatatagatactccaaatggagtagatgaagaagttcttgtaatcatgaaagagatgagtaggaaagaatttggaaaaacaacacggtcttttaaagataatacagctggatatcttcaaaaagaattggaaaagttgtatgctgtatcaggtcgtaatttttataaggtgataggtaaggcacaaaaaatgttaaataaatatggggctaaaagtagttatgaatttatagaaggaggaaataagattcatttttga

SEQ ID NO: 128 - DNA, 9945 bp, Prevotella pallens
atgaaacagacgctcactttggcattagtcgctacgatcgtgacagtgtccgctattgccgttgcgcaataccaacaagacgattctcttgcagcacaggagaagggtacagaaaacatttatatggtttcttccgggaaagttcaggctatgcccggacagcttttaggaaagaaaaaaaaagggaacaagatatccaaaggggaactgccccgagaggaacattccgaaaaacatggaaacgatgttcctgcggggcttggaagctccacgtcgtttgctacaccaaacagcggaattgtcggcatacctgacggacgagtgtcagacaatcccgaagacaaccttttcgagattactcttgccaaggttccttccaattcacgggtatggcttgtttatgacctaaagggtgtatcctctgcatcgggcgtaagcaagagtatcaacgaccgtccgggagtgggcggttatcttacggcactatccaaggaatggaagaccgttcgggaggaaatcagtccctcttgggttaaggcaggtaagaacaccatcttgttcacgcttccttctgatgcgtcttacagttatagcgtcaggaatgtccgcatagagacctccccgctcgaaaagatacaagaatccattgtgttctcggagcatccgacagcatacggttctttggcatacgtccatggatttatccgtggcaaagctgatgggattactatatcaggacaaaagataactgtcagaaatggagagttcgaaggtgtagttcctgttagcacaggtcaattgtctctcacggcttcggtatcaggtaagagcgtaaacaaaacgctttctgttgcacggaatagcaaagctgatttcagccgtgcctttgtttctgctggaacagcggttggaaaacaattccttgcccaccaatccgacagccttgtcatagccggcaatacgctctccgttgccaagggcgaaatttctaaaacggggaaatacaccattacagcacttcgtgaaacggatatccccgccttggactatggtatgaccaatgtgacggcacgtgacgaggggtatcgcttcttgcctcacggcgaacactttgctgggaagggtgcgacagtcaaaatcaagtatgaccgcacaaggataccaagcggttttacagaagacgatatcaacacctactatttcgataaagagacaaaacattgggtggctctcgaaagggtgaaagtggacaaggcttctgcctgtgtggtatcaaagaccactcactttacagatatgattaacggtgtcatcaaagcccccgaatcaccacagaccgacggattcacaccaacaatgatgaacgacatcaaggcagcggatccgacatcaaaaatcaatctcattacacctcctacagccaacaaccgaggttctgccaatcttcagtatgcctttgaaatgcctcccgcacgcaatggtatggctccttctttgggcatacagtacagtagtgaaggcggtagtggatggcttggagagggttggaatctctctgttccttctattacgttggatactcgctggggtgttccaagatacgatacaagtaaagaaaccgagacttatttgatgtcgggttctatgctttccacgatgggtgacgacggcaagatgggtgtggctcaccgtggtgagaagatgaaccgaaaagcggacagacagttctacactcggcagggaggagacttcagccgtattatccgaaagggtaattctcctaccgactatacttgggaagtaaccgacaaacaaggaatcaaatatatttatggtggagaaggtgccgttctcaaaggtaccatcaccgatgcaagcggtcaaagccgtgaagtgattaccgaatggaagctcaaacgtgtggaagaaacacacggtgattatatcgaatacgtctatgagacagccgacgaacctgttcgtggtggacttgtagcaaaagccatttatcttaaggaagtacgtgctggtaatagcggacaagcaccccacacagtggttgtcttagaaggcagtaaacagaaacgactcaaaaacaacaatgcaagatatggcttcctaacctcatcgaatcgtttgttggagaagctaacggtgaatttccaaggaagtacgctccgcagttatgcctttacctatagcgagggtgcgttcaacaaagatgtgcttacgggtgtgaagcaactcgacgacaaaggtacagaagtgtcttatcagaattttgactattatgatgatgtacaggctgctaaggggtatgtgccttttaaggaaaaacaggaaacatggaatacgcacaacgaccatttaggtgcaggcttcttgaatccattacaatttgtcagcaaagctttttctgacaaacccagtgcccttggtggaacaacgagtttctcccttagtggatcattttatgccggtatcggtccgatggatggagataaatggaaaggaaataccataggcgcatcttacgggtattctttggataagagcaatggagtctctacattggtggatattaatggtgatgggcttcctgataaggtctttagaaaaggtggcgcactttattatcgtccccaaataccgacttcgcaaaatagtgaagtactatatggagaagatgtgcgtattgtaggagtctctggtttctccaagataacaagttcaacccataatggaggggcaaaagccactgttggttatcagttattcacggcagaagtaggtgttgatttctcttcgaccaaaaccaagacaacggaatacctttcagacatcaatggcgatggcctcgtagacttggttttcaacaaaaaagtgtatttcaaccatattgagttcgacaagcaaggtaaagccattcctgttttcaccctcagcagtgctgatacgccgagtccgattatctacagtggtaagttagatgcctctgtcatcaaggtagatcctgcagagcaggaagaactgattaaatcctctcctatggaagatatggtacgtgtatggcaggcacctaaagatggaatcatcagcatctcgggtacagttagtttgattactccaacaggcgaatacgataccgatgagtatgctcatgctgatggtgtgcgcgtagccattcaaaaaggtcgtacagaactttggaataagaaaattaccaaaggagatgcaacggcttataatgctacggcacagaatatcactgtcaagaaaggcgaccgcatttatttccgtgtccagtctggtacggaggaaacaagcaacggtgcctttgacaacgtgaaatgggcgcctgtcattacctatacaggtgcggcagaaacactccccggcggattatctaccactgtttatcaacctcaggagggtgccatttatgatgccagtacactgaccaatgtggcagagagtgcttctttgaacctgtcaggcaagttcaccaaacctgtcaccacggatgacgttacgcttaaaatcattgcttcaaacagtgaaacagatagtataggaaacaagaatccgacatatcagcgtaaggtaatctatacccgtacctttgcatggaaagaagcatttaacggagaaattcaacaaacaatccctaaccctgatggcttgacaaatctgaactttgaaatcagttcttcttctaatgtggactggtcgaaaataaagtggacaccacaaatagagaccataggcaaggatggtagcaggcagcgtacggcaggggcaacccattatgttctctttgctgacatggtcagtgaaggtaagccagtagtacttgcttccaatgtttcaaccctgacagttactccgagtatcacgatgctaccaccaacggcaaacggaatggtgacgatgactgtcaagactgtagataaactgctgggtaaaaagacttacacgttcagtggtggcagtcttttaggagatccactgataattaccggtatcagtgcaggcaagatatggatagattactcttattcaggtaacatctcaggtcagacagtaacttctgcagctactgtcagtggcataggaacggtactggcaggtttctatgctcagacagagaacaaaggcttcggcacaatgtatcgtggttggggtggctttgtctacaatgcttccgaaggtaggtatggcaaacctattgatgaatcactgttgaagctccccgatagcaaggatgccaagataaatccattaaccatgccatttacccccattggaacagatcaaatgacctttgcacgctggattggtcaaaatgaattcatttatctgacggcagatgcaatggggactgctcgattgggtgagcagcaagtcatattgacaaatcctttagaaggtagtacagaaacagcggcacttacaggagattgtttgcaaggaacaggagccactgctgtgacactggtatcaaccagcaaaagtacagtcaagcaaggaggtagtatgggaattacctacaatgaagcaggaggaacgtcaacaacagatgtaaccatgacggatatgaatggcgacggttatccagacatcatcgcaggcggtactattcaatacaccaacactcaaggaggtctcagcggagagaaatatagtggcatgggtaaaaccacagggaaacatagttccaaagcatggggagcaggcggaaaacctgtcgcttccggtgtagcactcttggatatgatgacaccctacaaaggcggttctactggtacgcaaatgaatactgggctcaaaaaagctctcaataacctgcgtacatctttccttgccaaaatatccatatctggtaacattcctgagaatacagaagatgctgtagaaacattcatggacatcaatggggatggactccccgataaaattctgactgatagaagagttcgattgaaccttggatattcgtttactgatcctatagcatgggatatagaccgcttacagggcggaaagacaagatcttacaacataagtataggtgctggtgatacgatttttgcaaaaaaacatattacagaagataagaaaagtatagtaaaagcttcggggagtattagtggaggagttggtttggtatcctctcgcggtgtagaagaatatgatttgatggatatcaattccgatggcttgcccgataaggtctggatgacagacgataaagtctttgtcgccttgaataaaggagacggatttaccgatggcattctctggaaaggaacctcgttgttgagtgagaacatctctacagcagaatcagttaatggagcatttacctatacgattttcactcctatgcctactccagttatcaaaatttgtttgaatcctggcacaagcacaggacactccatcaaccgtacaacctacgctttgcaagatgtggacggcgacggctacctcgacattgtggaatccgataaggaaagtgaactgaaagtaacccgctctgccatcggcaggacgaacatgctcaagagcgtgaccaactcccttggcggaacctttacactggactacgaacacagcacgcctacctacggcctgcccggtggtaaatgggtaatgtcgtccgtaaccattgacgatggtatccgtgatgatggaccgatgatgaagacgatgtttgcctattcagatggacagaaggatcgccacgagcgtgaattcctcggttttggaaaggtcgtaaccaagaatatcgacaccgaacagggagaatccgcagtctatcgtcaggctgtgcagctctatgatgtgtccacctactatgcacagggcaatgagcttggaacgtctgtagaggatgccaaaggcaacaagtacaccgagacacgtaatgagtacgacggctactacctcactgccaatggcgacaagtacactttcaccaagcagaccaagctctgtagcgaccgcgcctctgccttcgtaccgctacgctataccgccaataagcagtatgagggacaggcaactggtatcaccacctctgaggcttggaacgagtattacctcacaggctatcacggagagctgaagtcctacaagttcagtgacaagggcaagttgggtgctgacggttcgggtaagttcgactaccaaaccgcaatacaatatgctcacaatgataacaaacatatcttcgggctacctaccaatgtaaccgtaacgggcggtgatggtaagacttatcatcaagtatctgcgacttacgatttgaactatgccgaccatattacacagattaaacaacaactcggaagcggcgaagccgtctctgattatacttatgatgcttacggcaacatcatcaagaccacgcttcctgctaacagcaagggacagcgcatgtggtacacctaccgctatgagccggtgatgaatatgtatgtggagcgcatagacgatgcatttggctaccgtagcgaggctgccaacttcgactaccgctatggcatggcactccgccgtatggatctcaaccacttctattatgaaacggatatagacaacctcggacgtgtgaaagctgtgcgcgggcctaatgagttggcaacaggtgtgccttacatcattgcctttgactatcaacctaaggctactttcggcaccaacggcattacagtgcctgcttacgcagtgacgaagcattacgacatacagcacccaagcgatgatatggagaccgtaaccttcgtggatggcttcgggcatcccgttcaggtgaagaaagacggtgtggttaccacagcttctaagggtagtgctccgaaagacgagaccgtgatgattgtcagcggacgcaatgtctatgatgctttcggtcgtgtggctaaggcttactaccctgtaaccgaagcagtgggaaacaagacaactttcaacaaggcttttgacaacgtgtcgccaaccgtaacggtttatgacgtgcttgaccgtgctatgaaagtaacgcttccggacaatgctgagaccaagacggagtactctacggacgcaggtagcaatgcactcgtaacgactgtaactgatgcgttgggtaatcgtcaggcaacttataccgatggtagtggcaagacggtgaagaccgagcaactcagcggacctgacggtatcattaccacttccttcgagtatgatggcatcgaccgattggtcaaggtaacagacaccgagggcaacgtaacgacatccgtctatgatatgggcgatcgtcgcacagaggtaaatcaccctgcaagcggtatcaccacctttacctacgatgccttgggcaatgtgctcaccaagcaaacagccaacctcaaaaaagagggtaagaccatcaattacgagtacgattacggtcgtctgacagcgattaactatcccgaccatccggaaaacaacgtgaagtaccattacggtggtatcaactcttcttacaaccgaattggcagattgatgctccgtgaggacggtagtggcgctatcgagtattactacggtaagatgggtgaggtcttgaagacggtgcgcacgctgattgtgccaaaccaggctgtggcaacctacgtaacacagtggaagtacgacagccacaaccgcctcttggaaatgatttaccctgatgaggagaaggtaacctacggctataacctcggtgggcaggtagaccacgtccgtggttacaagtcctatggctacgactatgtgaacaagataggttatgataagtttgagcagcgcacctatctgaagtattgcaacggagcggaaacgttctacagttacgaccctgcacgcagacggttgcagaacctcgtggtgaatgctaaggcaggcaccatcatggacaatgcctacagctacgacgcagtgagcaacgtgctcggtattaagaacaatgctccactcccacagagtggaaaggcaggcggacagatgagccatagttatacttatgacccactatatcgtttggcaagcgcaacgggaacttataagggaacggacaataaatccgcttcttatacgttatctatgggctatgacaacatgcatcgtatcacgagcaagaagcaacatctctcgcagacaggtgtgcagtttgacggcacgctcaacgcaggctacgaactcgcttatacttacggcaaggatgcgggcagaaagttccagcttgacaatgttcgtgatattaactaccgaacggaagaaactcctacggagagtaccaatatcaacaacggacacaagtacacctatgatgccaacggaaaccttgtctacatcaacacctctcgtgtaaagaaagacggcaaggaggatgaaaaggcaaccgagcagaagtacaggtgggacgaggagaacagactccttgcagccgatgagaacggttttgtgagcaactattggtacgatgccgatggcgagcgcacggtgaaaaccagtggcgagaatgaagctatttatgtgaactccgagttctctggtggcaacacaggtacggcacgcttcagcctttatgtcagtccatacctcgttgctgggcaaggtggcaaatatacgaagcacatctatgtaggcagtcagagaattgtcagcaaactgggcgacttggcttcttatggcgcagacccaagacgaataccgtatgcaggcaatgaggcggatggcttgactatcaactacaaggataagtacaaccagcagttacaatccattaaggataactacaagacgtttgacttgccatacaacggtaaggacaatgacgactatgtgaatggtcagggtttctgctgcaacgacggcacgccggaggctgcacaagcccgtgcgatggcacgcacaagagctgcaaatggcaactttaagcccaacgacgactacgaaaagatgcagttctactaccatcctgaccatttgggtagcagtagctacattaccaatcttgatggagaggtggcgcagcacatcgagtatgtgccatttggagaagtgttcatagaagaacgcaacaatacgtggaacacgccgtacctcttcaacgctaaagagtttgatgaggagactggtctgtactactatggggcacgctactatgaaccacgactcagtctatggatatcagtagatccaatatcaaattatgatcctcgaaacaatgaaaattatttagatggagagcataatttgggtgtatataatacgtttaatcttgctccatatgggtattgttatcaaaatcctatacgattaatagacccgaatgggaaacaagttgatgcagtggatttcgtcccatttttgggtagcggaagagatatctatagaggctttagggatggtgatatcttaactggagccataggagttggcgggttaattgctgatgtatttaccttaggttcagggtctgtagttactggaggaataaaggctggcgtaaaggctggcgtaaaggctggcgtaaaggctggtgtaaaggctggcgtaaaaaccgcagtaaaacaagaaataaagcaagccgctaaaactgaaactaaagttgcggctaaggcgttaactcaagcatctaagcaaggggttaagtctgcttcggagttaggtattaaagatggaatgaaaacgacatcaaccaaagctttagagttaggacaagaattccttgggaaaggctaccgagaagttggtcctgatagatatgtttcagccgatggaaaacgagtgttccgcatgggtgacaatgatattttaggtaaacatggaggtggacctcatgtgaattttgaaacactgaagccaaatcccaacaaacctggaaagatgatggttgatcaaaattatcatgttttcataaccgaataa

SEQ ID NO: 129 - DNA, 9276 bp, Prevotella salivae
atgaagtattctacacattcactcctccttccgttcctgttgctagcaggaatcatactaaactcctgtaatggtggaagtaatcgttctgctaaagaaactgtaaccagtgattctctatccagtgatacagtctcttctgtacaaaaagatagcacttctcgaaaggctacttccttacgaacacaagtcaagaacagtgtacagaactcttctgtgaagagattttccaaagaagttgtaagaaatcaaaagttgaattgtgtagctactcacaaggcgaacaggaaatctgtaagactttttgcagacttaggcaaacgtaccgtcagcaagttttttgccaactccgacagcgatacgctcaatgttggacgagcccagcttgccgtaccacgtgaggctatggaaaagggtaaagttctcagtattactccacttagaaaaggtgaattaccaaccttgcctacgggtatggtgaacgttacaggtggctgtgacaccttaatggcaagaaccgatacggtgtcaggttatcgtttcttacctcatggtaatcactttgtccatcatctggcaagtatctcagtaccttacgacagcatgttgataccgaaaggctatactgtagatgatatccacacctattactatgatgaactgcaccaacgctggacaatgctccagtcaaaaggtattgatactaaacgtgaggtggcaatggcagagacatcacactttacggatgtcatcaacggtatcatcaaggttccagagattcccgaaacacagaattatgtccctacaggtatcagtgagctgaaggctgctgacccagcagcgggtattcagcagattgaagccccatcagctaatcagaatggtacggcaacactgtcctatcctttcgaagttcctgcagggcgtaatgatattggtgtaagtgccggcttacagtacagcagtgagggcggtagtagctttgttggctatggatggagtcttcctgtacagagcattgacatagagacccgatggggtgtaccacgttttgatgataagtcagagactgagagctatcttctcatgggacagcagctcagtgaccgactctatcgtaggactgattctctggcaagacaagctgacaagcagttctatccaatgactgaaggtggtttcagtaggattattcgaaagggtaacagcccgaagaactattactgggaagtgactggtaaggatggtacagtctacagttatggtggtcatggtggtcatgtcagtgatgctacttctcttaccgacaccaaagggaaccgtatcaaatgggcacttgaccgtgttaccgatgttcacggaaactttgccgctttccattacatgaagtctggcaataacctttatccggaacgttatacatggacaggattcggggagacggaaggactgtatagcatagaattcgatattgactctatagccacagaccgaaaagatgtaacgagtagcggaaggctgggcataatgcaaaaggacaaagggctactccgtaaggtcactgtgaagaataatggtcagcagctccgcagttataccttaaactatgaagaagggccgttcggaaaaatactgctaaagagcattgaacagcacgatagtagggatggtaaggttgctacacaatcatttgactattacaatgaccttagaaatggacttttctcttctaaagcagaggtatggaaggccgaaggagaagattacgaggcattcctcagccattcggtgcgtgggtgtgatgacaatctaagtctccttggtggtggagcttcaaaaagccacactacgggttatggaacaatggtaggtattggcttcgctgctggaacagtaaatattggtccatctatctctaatagtaagagttcaaattcaggtaaaattgcttttgtagatattgatggtgacgggttgccagataagctcttcaaacgaggtgacaaactttactatcgtaagaacatgagtgcagatggaaagaatttactcttcggaaaaacaatattgatatcaggagtaaactctttctctgatggtaatagtaccagtcgttctcttaatgctgatgcagctgttgaagttggtcttattggtaaacttaaagcctctgttggaatttcttatacacattcaaaagatcaagacaagacaaccacctatctttatgatttcaacagtgatggtcttacggacatagctgtcaatggtcaggtatattttaatcatattgtagacgggaaaccagtatttagtccagcaagtagtgtaactgccaatcctattattggcgaaggggctcctattgataaacattttatcccagactataaggtcatccgtgattccttggaaaaggaatatccactaaatgatgctgtccgtatgtggtacgcaccctttaatggtagagttaatatacaaagtactataaagaagcttagcaatcaaggggatggtatcatttacagcattcaacatgagggcaatggtttcatggttcgtgactctttattacaagctggtagcaaaaccaataatcttaactgtgatgtaaaagcaggagacagaatcttcttccgtcttcagtcccgatatgatggtgaggatgataaggtcctttggaatcctataattacttatatatctttgcctgttggcaaggatcggtatctgtcagaagacttaaaagcatataatagtaaggctgattatatagagggtgaaaacaatgtagcaatctttaatcgtagtggtaaggttacgctccacgccccttataggaaagaaaagactactgatgatgttacacttatcgtcacacgattggatcatcatggtgaaacgatagtaaaacgacttaaacttcctgctgacagtatcgtcaatggttcctatgactataccggtaacatagatgagaaagattctgtttcatacttcttcgaaattacgactacatccccagttgattggacaaaggtacaatggacaggtaactataattatgaagatgaccaagaaaacgtacgttttgtagcatctcgtaggatgttcaacaagcctgtaagtatagcagagagtaaagtgttgaaacagggtgttaccgcattgaataggaaataccgtcctaaacttttcattgttccagcactttctgttgtgcgcaaagataaaaagaatgacactgatactgccacagtatacctcactttacatgatcaaaacggactacccgtattgcatcatacctgtcgtttgaatacatccaatacgctccaagcagatactatcgtagttacagacacaacacttattaaacgattaaatacaggtaaggtaactgctacttttgcaataagtaatgaattagctaaatctacttatgctaaagttagtttcttacgtgatagcctttcttaccaaagtgctacatccacagttgttactgctgagcagcgtgttcttgtggatacgttagaggcttgtgtgttctctgggtataattctgttgattatggcaggctctaccgaggatggggacaatttgcttataacggcaataaagcttatgcctcccagccaatagaagtatcagcactgaccattgacagggataaatataaggatatagctgagcattataaatccacgcacgatggcaatcaacttgcaaagagtcttactcctgtcaatgagcagcgtttctttgtgatgggctatgacacaaacaagaggatgtatattggtgggtctgaacatgtttttatctctttagatacaatttgtagctctcgtatcggcgaggatgctatcataatagacagtgttcattatgctaagaatgcaggtgaattgtctgcccctgtgctcatgagtgagtcaaagagtaatggctatggtgtaagcggtggaatctcctatgcaggactcagtggcagcaagagtacacagacttcttatagcaaggtagctctaatggatatcaatggtaatggttaccctgattggttagaggaagtggatggcagtattgttactcaatacacaaaagcaacgggtacacttggtgaagatcgcatgaaattaaatgtcagtcgaccaagattcaaagcaagctcttctactgtcggagcaaatggaagtctatcaaaacaggcttcggcaaagaacgctttagctattagtatcaaccctaaaccacaagacgatcaaactccaggcggtagtgatacacataattcatccaatggtaatgctatctccagtgtgtctgtgagcgctagcggaaactttacatcaggaacgtctcatacagagagtgattggatagatctcaatggtgacggactacctgatatgctctttgatgacaaggtgaagtttggtcttggatataactttacaaatgaggagagtagtggtgtaacttcgttggagtcttctgaaaatagtacatggggtgcaggacttggtacatccattggggtacttggtaatgctgatatttctttcggtgtcaacggaacaaagacgacaaccaaatataatgtatcttttatagatgttaatggtgatggcttacctgataagataactcgcagtggtgaaaagttcactataatgctgaatacgggttctggttttattccttattccgaagagcaacaaggtcgtttcaatgagtcattggcaacgtccgtttctcaatatggtaatttctcagtttccattccaatacacattctgtttttaaaactaagaattacagctaaggctactaaatcttggtcaagtggtgttagtttcacaagtgcagccttgagagatatcgacggtgacggacgtcccgatcttatcatatctgacggggcaaagcagcttgttgtttatcgtaaccttacgggcagaacgaacatgctgcgctctgtgacgcttcctttcggtggacatatcaatatcaactatgagcagacaactccaagttacgacttgccgggacgtcgctgggtgatgtcatctgttgagacgacaggtggatacaaggagaacggagcggtacgaagcaggaatacctttgaatatagtggtggctatcgtgaccgccgtgagcgtgacttctatggtttcaagcaggtacgtactaatcagatagacacagagaatggtgatagactctatcgttactccgtacaggcctatggtaagaacagggattactatgcgcatggacttgttacgagtgagtatctctataccgctgatggaaagaaactgcaggggtctctatatgactacgacctgaagacactcgccgttggtcataatacggctgacgctgttgtcttccctgccctaaagacgcttgttcagagtaactttgatgtaaatagtggagacagtctggcggttgctgtcaataatacttacgatgactatggtaacctacagggatataaggagacgacaacgggctatagcttagaggcaaacatcaactatcataagattgccgataagtatatcgttggtgttccaagtcatatcactgtcagcagtggcggtaagacttaccgtgaacgctcaacgaaggtggacggcaacggtgagataacggagattatactccataacggtgacaagccatcagtctataacatgacttacgatggctatggtaacatcacacgcatgacgaagccggagaactacaatcatcagcgtatgttctatgcttatacgtatgacgaccgctatcatagtcttgtgacaagtgtcaaggatgcatatggctatagctccagcacggcttatgatggtctttggaatgctccgtctgtaacgaccgacctcaacgggcagaagatggaatacacctacgatgccttaggacgtcagcagacgattcgtgctccgtatgagatagaaagcggtcagccgtttactatccgttttgagtacttccctgcagagcgtaaggcacataccatccattactctaaggaaggaaacattgatacctatacctttgccgactcgctgatgcgtgccgtccagacgaagcagacgggtgtggtgtggtctggtggaagcaatcaaaaggtctctattgtcagtggaagggctgtcatcgatgccttcggacgtaacattacagcttattacccaatgacggagagctatggtaacatcggcacttacaaccatgctacgggtgatctgcaggcaaagacggagtatgatacacacgaccgtaccacgagtgtgacgcttgctgatggcagtgtgacacgtacggcttactctatcggcagtcatgagggtgaaccgatgctccagacaactgtcacggatgcactgggacgacatgcggagagctataccgatgccaagggacgcaaccgtgagacggtacagcatgcccgtagtgaggatatcacggtgaagtacagctatgaccctgtcggtcaggtgatgatggttcagcatcctaacggcaaggagacgaaatatgcctacgacttgcttggtcggaaactgatggtgaatcatcctgatgcaggtgagacggatatgacttacgatgcggcaggcaacctcctgacgaaactcacggcagaacttaggaagtcgatatctgacaagggttacatctcttacacctacgacttcgaacgactccatgaggtgctttatcctgaaaatctcttcaatcgtgttacctacacctatggtaaggctggcgataagtataaccgtgccggtcgtcttgccctcgtggaggatgcttcgggtggtgaagcgtattactatggcaagcagggtgaggtgacaaagaccgtccgtacggtgatggcgagcgtggcggatatccggacttatgtctatggtgctacgtatgacagctggaaccgtgtgcagacgatgacttatcctgacggtgaagtggtaacttatcactacaatgctgcaggacaggtggagagcatgacgagcaataaacagggacgtcagagcgttattgttgataggataggttacgacaaagagggtcatacggtctatacgaaactcggtaacggcacggagactacctatacctacgacaagcagcgtgaacgtctgcaggtgatgaaccttacagcagacggtcagactgtgatggagaacaggtaccagtatgatgctgtggataatatcctcggtattacgaatgctgccaacccaacgtcgctgacgaaactcaacaaggcgaagctgggaggaaggagttcgcatacgtatgagtatgatgatctgaaccgccttattcatgcaaacggtaaggcaaaaagtgcaagttacgatatggtgatgtcgttcggacggatgagtgagccgctgacgaaggtacaaaaggtggactcaacgacgactgctaagtcttataactttgcttataagtacgaggacagtaaccatccgacggctccaacgcagattggtcacgatcattacacgtatgatgccaacggtaatccaacgctggtaacgaacgattcggcgaatactacccgtgagatgtattgggatgaagataaccgcctgatggtcttaagcgataacggcaagacgagtcgttatacttacaacgctgctggtgaacgtattatgaagagttatggtacgatggaaggtgtgtatatcaatggtgcaccacagggtattaccttccacgagacggataacttcacgctttatcctgcaagtatcctctctgtaaataagactcgctttacaaagcattacttcattggtgataaacgagttgcttcaagaataggaacaggtctgttcaataatgtctatgggcgtaacggctcatatgtaacagctggtcagcaggattatgctgaacgtatgaatcagatacagaagcagaaagaggcatactacaaacagcagggcattgcacctggtgtacctacaatgaagggtgcgtatggtgatccagagaacacgggtgttggttataatgccgttctcacagaactcggtaaccatgatgtgccacagggttgggtacagactccgaagccgaacaccacaccgaataccaaccccggtccacctgtaagctggaacgacccgagcaatcctgatgacccgcaggctggttatggctatattcctaatgacactacgaaagaagaaaccttcttctatcacagtgaccacctcggcagcacatcttacatcacagatgataaagccaacatcacccagtatgatgcttacttaccatatggcgagctattagttgatgagcatagcagcagcgaagacctaccgtacaagttcaatggcaaacagttcgatgaggaaaccggcttgtactattacggtgcaaggtacttgaaccctatggcaagtatttggtatggagtggatccgttggcggagaagtatgtatcaacagggtgttatgtatattgtatagataaccctataagactaatagacccagacgggactcattgggttgaagataacaaaaaaaggattgtctggagagaaagtattaaaaataagcaacaagccgctgtagcaggactaatttatagagggaaatcgtatcaaagattctttgtaaataatcaaacatatgcagtaacacgagaacaatatactcctgatcgtcgcctcattatttcaaaagctccaaaatatagaatggatttttcaggaaaggttgtaacagccaaacaattaacaggtagaaacttgaatacttcacgtaatgcaccatatggaatccaagggaaggcctatttgaatgctgtcttttctgatggcacaatacatactgcagctactttcgagtttaatagtggtccatacgctaatggacctacacctaacaactcctatgaagcgcttggtgctgtgccaacaaatgagtctggaatgttaaacaacggacgtacaggatggaaagttctcttaccgaattataatggaagatcggggcttagagtgcatccagatactaattcacctggaacaaagggctgcattggtatagtcggttgttacgaagaattaaaaaatcttggtaatttctttaataattatattggtcctagtggaagacataggatgatttttaattttaacataaaaggtaacccaaattatggcaatgaaggtagacataattctcgtcttgctcaatag

SEQ ID NO: 130 - DNA, 9198 bp, Prevotella sp.
atgaaaagacttacacatatcacgctgacaaccgtcattatgctactgtcgctcgcatcctgcaacgatggcagacgcacttcacctgccatcgacgtactaggcgaagaaacaccacacgcgacgaaacccaaaagacaagacacagataaagacacggtgacatcaacgccccaaaaaggaacgggtggcacagtcgtaacacatacgatacaaggtgcggaagctagcaaagccttgtcgcgtctgcgcaatttccgccaccgcacagtgagcaagttatttgctcgtgacgtggccgactcactaagcgtgggacgtgccgaacttcgagttccgcgcggaagcatggaacgttccaagatgctgagcgtaacgccactagataaaggtgaactaccccagctaccggcaggtatggtgaacgtgacaggcgatagaaatacgagcgtttccgtttcgttgaaagatggtgtagcgggctatcgtctcctaccccatggcgaacacttcgtgcacgaacctgcaaccatcaccgttccctacgacagcacgctcatccctgagggttatacggcagacgacatacacacctattactacgacgagctgcaaggcaggtggacaatgttacgccacaaagccctagacaaggacagggaggtgttgatggctgaaacatcacacttcaccgacgtaatcaacggcatcatcaaagtacccgagagtcctgaaacacagaactatgtgcccacaggcataagcgaactgaaagccgccgatcctgcagcgggcatagccacggtaagtgcacccacacctaaccaaaacggaacggcatcgctgggttacacctttgaactacctaaagggcgtgctggtatgcaacctagcgtgggtctacaatacagtagcgatggtgggtcgtcgtacgtgggttatggttggagcctgcctgtgcagagcgtggacatcgagacgcgctggggcgtaccacgtttcgaccccaacaacgagagcgagagttacctactgatgggcgcaaagctgggcgaccgcacctaccgcacggccgaaccgcctgcacgaaagccaaacaagcgtttccacccgctggtcgagggcggtttcgcgcgcatcatccgcaggggcgattcgcccacaaactatacgtgggaagtcactgccaaagacggcaccacatcttatttcggcggtattgagggtaagatagtagacaacgccgtcatcaaggacggtgatggcaacattgtgcgatgggcactttaccgaacggtggacacccatggcaactttgtttcgtacacctacgagcatcgtgatagtaccctctaccccaaggtctaccgctatacgggacacggcaacgaagagggggcatacgctgtgaacttcaaatatatttcggggacacgcaaggatgccatgaaaagtggacgcctgcgcatattgcaaaccgacgacgctttgctcgaacgcgtggaggtgagtttcaacggtgagcccatacgtggctatgcgttgcaccatcgcgaaggaccatttgctaagacgctgcttgatagcatcgtgcagctcgacgccaagggtgcaagggtagccgcacaaggcttcgactactatgatgatgtgaagggagggatgtttggaaaagcggagtcgtggacatcagaggctgacaataaacacgaacatttacccttattgcaaaaggccataaacggttttagcaacgagttgagcatgcttggtggcggatactccaaagggaagaccttcggtggtggtctgttcgtcgggtttggcgtaagtgttgccactgtgaatgtcggggcttcttacatacagtcgaagaatgagaactttggaaaagtagcacttatagacattgacggagacggattaccagacaaggtattccaagcgcgggatgggctttgctataggaagaacctctctggtgaaacagggaatctcatttttgcaaaaagtcgcatggtcaagggaataggagagttttccagaggaacaagttcaaacaagacactcaatgccaacgctgctgttgagctacctttcgtctcccctggcgtcagctacagccaaacttgggataagacggagactaagatctacatgtccgacttcaacaacgacggactggtggacatcgccaataacggcacggtatggtttaacaggatcggcacggacggccttcctacgttcgtaccctcgacgaaagaaacgcccaaccccattatcgggcgaagtgcagagatagattccacctttattcccgactataaagccatcagggactccttggaaaaggaaagccctctccacgatgtggtgcgcgtatggcgtgcaccgttctcagggacaatccacattgccagtgtagtgaataagtccacaacttatggtgatggtattatatatagcgtccaaaaggaggaaaacgtattaaggagggattccattctcaacacaggaatgagaaaagacagcctcacaacatctgttaaagccggcgaaaggctgtttttccgcttgcagtcgcgctactcgggtgcggccgacagcgtggcgtggtctcaacgggtgagatatagtcagattgttggcggtaatgcaacctacttgggacaagacctctctcactatgatgccacatccgacttcttggaaggaatgaccacaggtatatccttgcccaaggatgggcgcgtggagataaaggcaccttacagaaaggggcgaacagaggatcatgttacgcttgttgtgcgaaggaaagatttacacggtgaacacatcttgatggaaaagaaactcctagctggtacttctgttgaagatacgtttgaggatgcgttcgacgtattggcgaaagattcggtacagctgacctttgagatgctgacggatgctcctttggaatggagaaatatgtcgtggaaacctacgttaaggtatgtctccacacaagacacgctccgtgtaattccttttagaaagatgtataacaagcctgtacttgtgagggcttcaagaaatgttaggaaggacttagcgaagaaccagaaatacgacccaggagtaattctcgtacacaaatttaaagtgaagcgacaagataggaagaatgacactgatacagcaaccgtaaatgtaaacttcaataaggaagacggcactttactgtttaaacgcaaatatactttaaccaaaggcgatagcataaaggttgactcactggccattgttgatgcaaccttgttggaagaactctgtaagggaaagacactggcaacttttagtgtagataacgaattgaggtcggttgctatggctaaggtagaggtcttacgcgattcattagtcttcaaaaaggattcgataacgcaggagacggtcttagaccacaaggagagggttcttgtcgacaccgttgtatgctctgtcttctctggttacaattcccttaatttcggacatctttataggggatggggacagttcggctacaacggaaatagagaatacgcaaaccgtcccattgaaacgtcggcgttgaccatcgacaccgacggatacaagagcattgcggaaaattatgacaagagccataagaaggaagacctcgcaggcttgacagagcccagcaagcaacgcttcttcgtaatgggttacaatgccatgcggaaggtctatgtcggtgcaaccgatagtgcctacgtgggcgcttccttccaatgttcctcacgtatgggtgaaagcgagattagggtggatagtgtgcagtatgcctcaggagaaggtctatctgcaccgatattacaatccaagtcctccggaggtggcgtgtctgcaacggggagcggtcctctcaagtttggcataagtggcagcaaaagctggcaaaagtcccatacgggagtcgccgcaatggatatcaatggcgacggctatcctgattggatagatgagggcaatagccgtatacgcacacaatacacttcgcagaccggaacactcagccaacttagtgtcaagactgatattccgatgcccgagttcagttcgggtgctaacactctcggcataagcaatgatggtgccattgctgtaagcattggcaacagaaaccgttctgaggcgggaagaacaactagcaattcctctccaggcgatgtcagcagcatgagcaatactaatgagaatccaaacaaggctactacccctacgagtaactcgacagggcaatgtgaagggcagaatgccagtgatggtaatgccgtttccagcctgtccgtctcagccagtggaaacttctctcagggaaactccaagactacacgcgattggttggactggaacggtgatggattacccgatatggttgaaggcaatacggtgaggtacaaccttggttacggcttcacaatgcacatgccgcgaggctgccaggacatggatgccacatccaacaccacctggggtgcaggattgggaacaaaaatcaccattctcggcaacgcggagattacaggaggtttcaatggcacgaagacaacgacccatacagactgttcctatgccgatcttaacggcgacggaatgccagataaaatcatcagagatgacgacaaggttaaagttgccatcaatacggggacgggcttcgtcgacgaagcacaagacattcagggcagcgcggggaaaaaccttgccacgtccgtatcattgtatggcagtggggcattctccttcagagtctacctgctattcctgaaactgtcgatcactccacacataaccgcagcatggtcgacaggcgtgagccgcacggagagtgctttactcgacattgatggcgacggcttgcccgacttcgttgaaagtgcaggacctgatgcccttgtcgttcgtcgcaacctcactggccgcaccaacctgctgcgcagcgtcaccctgcctttcggcggacacgtccgcgtagagtaccgacagacgctgcccagcttcgccatgcccggccgccgctgggtgatgtcggccgtggaaacctcgggcggatatgccgagaacggggcgacgcgcatgcgcaacgagttcgcctacgagggcggataccgcgacaggcgcgagcgcgacttcttcgggttcgccaaggtcgtcacccgacagttggacacgcagaaggacaatgccgtctaccgcacgcaggtgtccgagtacggacacaaccgcaacctgtacatgcacgacctcgtcaccgccgaaacgctgtacgacgcgcagggcaacaaactgcaaggcaccctcaacacctacgaggcggtacggcagcgcgacgacagcacgagcgtgttcccggcgctcgtttccattaggcagacggtctacgacaacacagggcagggcagcatgagcaccaccgtgcacaacacctacgacgcctacggcaacctcgcatcctacaaggagacggccaccgactacgagttgcgggcggacatcgcctaccacgaactgcgcgaaagccacatcgtggcactgccgcgacacattgccgtgaaggacaaggcgggcaaggtgtaccgcgaacgttcgacggaagtggacggcaagggcgacatcacccgcatcaccatgcacaacggtcagctgccctcggtgtacgacatggcgtacgacgcgtacggcaacctggccgcgctcaccaagcccgccaaccacaagggtcagcgcatgcgctacgagtacgcctacgacggcgttctgcaccaactggtgacgggcgtgaaggacgcctacggctacgcctcgtccaccgactacgactgccgttggggcgcaccgctggaaacgcgcgacatcaacggcaaccacatgcgctatgcctacgacgacgcgggcaggcccaccgcaatcatcggcccgaaggagctggccgcgggcaagccctacaccgtgcgtttcgagtaccaccccgcaggccgctgggcgcgcacgctgcactacgcccccgagggcgacgtggagacgcgcaccttcgccgacagcctgatgcgcgccgtgcagaccaagcgcacgggcgttgtatggaagggcggggcggcccacaaggtgtcgatagtgagcggccgcaccgtacaggacgccttcggacggaccctccgggcgtactggcccaccgaagaaggcttcggcagcatgggtctatataataaaggtgtgggcgacctgcaagccgtcaccgaatacgacgcctacgaccgccccaccaaggttacgctgcccgacggggcggccacgacgacggcctacgccatcgtggaccacgacggggaacctatgctcgagacgcgcatcaccgatgcgctgggcagacacgccgagagctacaccgacgagaaggggcgcaaccgcgagacggtgcagcacgccgggggcgaagacgtgcgggtgagctacggctacgatgccgtggggcaagtgctcacggtgcatcaccccaacggcaagacgaccgcctacgagtacgacctgctggggcataagctcaaggtgaaccaccccgacgcgggcgaggtgacctgcacctacgacgccgcgggcaacctgctcaccaagctcacggcggaactgaagaagaccatctccgacaaggcggcaatcacctacacctacgactacgaacggctgagcgaggtgctctaccccaagaacctcttcaaccgcgtgacctacacctacggcaagcccggggccaagtacaaccgcgcgggcaggctcgtgctggtggaggacgcctcgggcggcgaggcctactactacggcaaccagggcgaggtggtgaagacggtgcgctcggtgatggtgagccaggccgacgtgcgcacctacgtccacgcggcaacgtacgacagccacaaccgcgtgcgcaccatgacctatcccgacggggaggtggttacctacggctacgacgccgcgggtcaggttacgagcctcaggtctaccaagcagggcaaggaagagacgatagtggcgcaggtgggctacgacaaggacggccacaccatatacacgcgcatgggcaacggcacggaaagcacgtacgcctacgaccgccagcgagagcggttgcagggcatgctgctaacggccaacggggacagcatcatgcagacgcaatataaatacgaccccgtggacaatattttggggctgaccaacgttattacgccaaaggcgccgaagaagccgaaagggttcggagggtccggccgtacggatggcatgggcggccccgatgccggaaaggaaaagaaggagaaaccgctgggcggtgcgttcagccatgcctacgcctacgacgagcttaaccgactggtgaaggccagtggcaaggccaagggcataggctacgccatggacatgagcttcgggctgatgggcgaaccgctcaccaaggtgcagcgcaccgactcgggttcggttgcgggcagctacgcgctggcctacgaatacggcgacgccgaccatcccaccgcgccctcgcagattgggcacgaacgttacacctacgacgccaacggcaaccccacgctcgtggaggacgacagcctgaacacggagcggcgcatggcgtgggacgaggagaaccgcctgacggccctgtctgacaacggcaagaccagccgctacacctacaacgcggcgggcgagcgcatcgtgaagagccacggctatcttgagggcgtatacgtcaacggcgcaccgcaaggcctcaccttccacgaaacggaggactacaccatctatcccgcccccatactcagcgtcacgcgccaacgtttcaccaagcactacttcatcggcgacaggcgcgtggcctccaagatcggtgcgggcatattccaaaacgcctacggccacggcgcaaacgtcgtcacggctgggcagaaagactaccagatgcgtatgatgcagatagaaagacaacgcgaggactactaccgcaagctgggcacgccgccgggagtgcccacgatgaagggcgcgactgccgaacccgagaacacgcacgagggctacaacaccatcatcagggagttgggcgaccacagcgtgcccgacggttggatacaacgccccaagcgcaacgccgtgcccggcacgcctcccggtccgcccgtgcagtgggacaaggccgaagaccccgacgacgtgcagccgggttacggctacgtgcctgccgacaccacgcacgaggacatcttctactatcacaccgaccacctcggctccacttcctatatcaccgacgccaaggccaacatcgcccagttcgacgcctacctgccctatggcgaactgctcgtggacgaacactcgtccacggaggagatgccgtataagttcaacggcaaggaactcgacgaggagacgggactgtactactacggggcgaggtactatgatccgagggtgagtctgtggatgaatatagatcctatgtatgagaaattccctaatttttcatcttacatatattgtataaacaatcctgtaaaactaattgatcctgatggacgacaaactcaagaacccgattcttggaaaacaatatcgcctgtaattcctaaggaaaagttcataggatggggagacccgtctgtaaaggataattataactgttttgcactatcaaaaaaacaacttaacgttatgggatataccgtgggaggtgcaagcgtttcttccaacttatatacttataatgaaaatagaggtgtaaatagagtcgatacccacaaggcgatatcgtatataaagtcagcattgaaccaaggagtgcctgttttaataggagtagatacacatgcgggttctccaaattctgataagacgaccgaccattatcttgttgttgtagggatgggccatgataaaaaaggtaattatcttcaagtatatgacaatgcgacttccattacaaaggatggcacaaaccctgagaacaagttgtactataattctaaaacaggaaaaatatctggacgcataccaaacatctattctcaaaattcacaaagaccatatacggtttcccaagtaaggacatcaaaagctttaaaaagaaaaaagacacgcaaatga

SEQ ID NO: 131 - DNA, 4707 bp, Salmonella enterica
atgggagaagcattctgggcggcaagggaaggcgacgcgctgctgcatacgtcctttctggcagatctggtgggcagtgcgctggaattcgccatcaatgcggttattgattttgcggcactggctgttgtggcgctggcgacgggggctacggtggcaacgctgggatgcagcgccgtattacttgtggggaccgtggtcggcgcgacgatgttgctgagtggcgccggggagaaaatcagtaaagcctgtgaagacatagccaacagcctttttccgccgaaaattgagggatatatcctgaccggctcaggcgatacccggattaacagcaaacgggcggcgcgggcggcggcaacggcattatcacgccatgatgtagaaaccctggatgcgcaggcgcaggcagaggcagaagaagaaaaacgcaggcaggacgccaaatcaatgtgggatgtggccggggaatatctggatgcagtaaaaggccgggcagagaatatggctaagggcgtcgtttccgtggtgagccggatgggatcagcggaaggatgggcctcgctgggaaatgatgctctggcagaggcgggcgatatgctttccgacacgggccactttatttcagagatgtggcagcccacggtggcaacggcatatccggggtctgacccgaaacaggatgataaaatcgactgccacaaacatccctcttcattcacccagtttatggcacagaaactgcaggcgctgacggatgacccggtggggacggtactgggggcgatgaacactttcgatgtgctggaagccggttttcaggcggcaagcgcgcttatcggcagcgtgtcgaacctgttcaaaggcgacgatgagccgcccgcagcagaatatatcgccgaagggacgcgggatgtgcgtatcaacagccagcctgcggcgcgcagcggggtacgctgtacctgcgaggcaaaagtggtggatgagcctgagaacggcgtacatgtatccggtgatgtacgtatcggcgggccgcttctggtggtacgggatatcaaaagcggtaagtcacaaataaccctggtgaccaccattgcgctgacgttcatgcagcccggacgggcgtcagctaaaagtgcctgctttatgatgggattgggcattaacatgatggttcagaaggcggggagtgcgctgaaccgcccggtaaacgccgccaccggagccaagtacctggcaggcgatgatgacgttgatttcagtctgcccggccacttcccgctggagtggcagcggacctacagcagccgtgatgaacggacggaggggatgttcgggcggggctggagcgtgctgtatgaagtgtgcctggagcgtacgccggacaacccggatgaaaactgcatgacgtatgtatccccaatgggacggcgaattgacctgcaggcggtggagccggggagcggtttttacagccccggcgaggggctggcagtgcggcgcagcgaacagggccactggcttatcagcagtgatgacggcgtgtacaggctgtttgaagcggacccgttcagcccacagcgtcggcggctgaaaatgctgggcgaccgcaacagtaactgccagcacctgacctacgacaaccacgggcgtctggtggaaatcagcggcgatcggcagcgcccctgcatccggctgcactatgagctggcagcgcacccgcagcgcgtgacgcgcatcttccgccattacccggaaggggagccggagctgctgcggcgttaccgctacgatgaggcggggcggctgaacggggtggtggacaacgcaggtcagtatcagcgcgagtttgcgtatgacgacaacgactgcatgacgatgcaccgggagccgggcggcgaacggtattactactcctgggcgtggtttgaaggcccggacgatgcggcgtggagggtgacgggccatcatacggacagcggcgagcagtaccgtctggactggaatctggcagaacgttcgctgtgcgtgacggatagtctggggcgtacgcgctgccactggtgggatgcgcagggcctggtgacggcgtaccgggacgaggccgggcagatgaccactttccgctggagcgatgaagagcggttactgctggggatgacggacgcgcagggcggcaaatggcgttatgtctatgaccgtctcggccatctgacggagacgcatgacccgctgggccgggttgagcagacgcagtggcatccggtgtggcaccagccggaaacggaggtggatgccgcgggggcggcgtggcgttatgagtatgatgagcggggcaacctgcaggcggtcagcgacccgctgcaccagcgcacggtatacgggtatgaccggcacggccaggtggtgcggataaccgacgcgcggggcggagataaatacctgcagtggaacgaagacgggcagcttatgcgccacacggactgttctggctcgcagacggcatggttttatgatgaacgcacgcggctggaaagggtgacggacgcggagagtaacagtacgcgttacagctatgacggcaacggacatctgacggaggtcatgttcgcggacgggcgtacggagcgttaccagccggatgcggcgggacggctggtgaaatacaccagcccggcggggcagataacacgctggcagcgggacggccaggggcgggtgcgcaggcagacggatgcgacggggcgcaggacggcgtatgagtacgacgcttacgggcggctgaccacgctcacgaacgagaacggggaaagctaccggttccggtacgatgttctggaccgggtgacggaacagacggaccccggcggcagccgccgggcatacgggtataacgcgctgaatgcggtgacggcggtgatatacggcggggagcgcgggggagaaatccgccacggtctggagcgtgatgcggcggggaggctgacggtgaaaatcacgccggagacgcgcacggaataccggtacgacgcggcggaccgtctgctggaaatccgccgcaggcagcatgatgcggcggaaggcggagagccggaagttatccggttcagctacgacagtgcgggtaacctgctgagcgaggagacggcgcagggcgtgctgcagaaccggtacgatgttcagggcaaccgcacagaaacgcagatgccggacgggcggacgctgcggtacctgtactacgggagcggccatctccagcaaatcaacctggggcgtgatgtcatcagcgagttcacgcgcgaccacctgcaccgtgaggtgcagcggagccaggggcggctggacacgcggcggatgtacgaccggacgggccggttaacgcggaaactgacctgtaaaggaatgcgcggtgtggtgccggagacgtttatcgaccgggaatatgcgtacagcggccaggatgagctgctgaaaaagcggcacagccggcagggggtgacggattatttttacgacacgacggggcgcatcacggcgtgccggaatgaggcatacctggacagctggcagtacgacgcggcggcgaacctgctggacaggcggcagggagagaccgcgcaggcgggtgcaggcagcgtggtgccgttcaaccggataacgtcataccgtgggctgcattaccgttacgatgaatatggccgggtggtggaaaagcggggccgcaacggtacgcagcactatcgctgggatgcggagcaccggctgacggaagtggcggtcatccgggggagcaccgtacggcgttacgggtacgtgtacgacgcgccgggcaggcgggtggagaagcacgaactggacgcggaaggaaagccgtataaccggacgacgtttttatgggacggaatgcggctggcgcaggagtgcaggctggggagaagcagcagcctgtatatctacagcgaccaggggagccacgagccgctggcgcgggtggacagggcggcgccgggcgaagcggatgaggtgctgtattaccatacggacgtaaacggcgcgccggaggagatgacggacggcgggggcaatattgtctgggaagcgggctatcaggtatgggggaacctgacgcatgaaaaagaaacccggcccgtacagcagaacctgcgtttccaggggcaatatctggacagggaaacggggctgcattacaatttgtacagattttatgatccggatatcgggaagtttatatcgggcgatccaatctcgctgaggggcggaataaacttatatgcgtatgcacagaatccgttaagctggatcgatccgctgggattgacaggggagtgggttaatcccaaagatattaatttctctcaaagaacaatatcacctcatgattatgccgaaattatgcgtaatggtggttgggattgggataggtctccattaagagtaattgatattgatgggcaattagtctcttatgataataggcgattagacgcagctctagaggccggattagataaggttaaagttattaggattgaccctaatgctcctcatcctgactcatctactggaaaaacatggttgcaaaaatttcgagagagatttagagacagaagaaatataaaggccggtggaatagtaccagataaaggattaaattctcgaccggaaagaacatcaagaggttgcaaatga

SEQ ID NO: 132 - DNA, 4239 bp, Salmonella enterica
atgagcggaaaaccggcggcgcgacagggtgatatgacgaagtacggaggcccgatagtccagggttcagcgggggtgctgataggcgcgccgacaggcgtggcgtgttcggtatgtccgggcggcatcacctacggtccgccggtgaacccgctgctgggcgtaaaggtgctgccgggtgagaccgactttgcgctgcccggcccgctgccgttcatccttacccgcgcctacagcagctaccggacgaagacgcccgcgccatcggggctgttcggccccggctggaagatggctgccgatatgcgcttacagatttgtgaccgtgaactgatactgaacgacagcggaggccggagcattcactttgagccgctgtcgccgggggagtcgtcatacagccgcagcgagtcgttctggctggcgcggtgcggggtgcttatgccggataaaagcaacccgctgcatgacctctggcagacactgccggaagagatacggttaagcccgcatatttacctggcaacgaacagtatacaggggccgtggtgggtgctggggtggccggaacgggtgccgggtgcggatgaggcgttacccgcgccgctgccgccgtaccgtgtgctgacggggctggcggacagctacggacgcacgctgacgtatcaccgcgccgcagagggagtgctggccgggagtgtcaccggggtgacggacggtgcgggacggcgttttcagctggtgctgaccacacaggcgcagcgtgcggaggcggcgcaggcggcttacgccacagcaggcacgtccggcacgtcccggtctgcatctgttgattttcctgagacgttgcccgccacggagtacggaacggataacggtatccgcctctcgcaggtatggctgacgtatgagccggacgctgagggcgaccaggagccggtaatgctgtcgcgatatgagtacacgccgggcggagagcttgccgccgtgtacgaccgtgggggtgtggaggtgcgccgtttcctgtatgacgcggaccatccggggcggatgacaggccactgctatgcgggcaggccgcagatgcgctaccgctataaccgtgacgggcgggtggaagagcagcttaacccggaggggctgagttaccgctatacgtatgagaagagtcgcgtcaccatcacggacagcctggggcggcgcgaagtgctgcacacggaaggtgaaggcggcctgaaacgggtggtgatgaaggcgtcagccgacgggagcgtgacgcgcagcgagtacgacccggcggggaggctgaaagcgcagacggacgcggcagggagaaggacggagtacagcctgcacatggcgtcggggatggtgacggcggtgacggggccggacggaaggacagtacgctatggctataacagccagcggcagttaacgtccaccacgtacccggacggactgcggagcacgcgggagtatgatgataaaggcaggctgacggcggagacgacgcggacgggtgagacgacgcggtacagttatgataatccgcagagtgaattaccgtccgggatacaggacgccaccggcagcagtaagtcagtgacctggagccgttacgggcagatggtggtgttcacggactgttcggggtatgagacgcggtatgagtatgaccggttcggccagatgacggcaattcaccgcgaggaggggcagagcgtttaccgggcttacaatagccggggcaggctggtcagccagaaagataatcagggccgtgagacgcgatatgactataacgacgcgggtgacgtaaccaccgtcaccgggccggacggcagccgcactgaaacgcagtacgacgggtggggcaaggcgctcagtaccacgcaggacgggctgacgcggcggatggaatatgatgctgcgggccgtgtgacgcaactgaccaacgagaacggcagccacagcgcatttacctgggatacgctggaccgcctgacacaacagacgggctttgacggacgggtacagcggtacggttatgacgtgacggggcagcttgtccgcagcgaggatgaggacctggtgacgcactggcattatgatgcgtcagaccgactgacacaccgcaccatcaacggagaggaagccgagcggtggcagtatgatgaatacgggtggctgacggaactgagtcacctcagcgaagggcagcgtgtggcggtgcattacggctatgatgacaaaggtcgccttatccgcgagcggcagacggtgaatgacccggaaacggggacattgctgtgggagcatgagacactacaggggtacagtgagcagggactggcgaaccggtttaagctggacggtctgccgccggtggagtggctgacgtacgggagtggttatctggcggggatgaagctgggagacacgccgctggtggaatacacgcgtgacaggctgcaccgtgaggtgttgcggcggttcggcgcgggcgcagcaccagagccgggtgcttacgaactgaccaccacttacacgccaggcggacaacttcagcagcaacacctgacgcagccgcagcttaaccgggagtacggttacgatgagggcgggaggctggtacgcatcagcgggccacagcagacgagggagtaccgctacagcgacagcgggcgcctgaccggggtgcataccagcgccgcgaatctggacatcacccttccgtatgccacggacccggcggggaaccgcctgccggacccggagttttatcccgacagcgccagtacggtgtgggcggataaccgcatcacggaagatatgcagtacctgtaccgctatgacaaatacggcaggctgacggagaaaacggaccgtatcccggaaggtgtggtgatacggatgaacgacgaacgtacacaccggtacgaatatgataaccagcaccggctggtacattatgtgcgcacacagcacggagaaacgcaggcggaagggcggtatctctatgacccgctgggccgccgtgtgggtaaacgggtatggaagcgggagcttgttcactggagcgacacacggatggagctgtcgcgcaggccgtatgtgacgtggtacggctgggagggtgacaggctgacgaccatccagaccggacagagccgcatccagacggtgtatgcgccggggagttttacgccgctggtgcgcatcgaaacagacgcggctgaacaggcgaaggcacagcaccgtagcctggcggagaagctgtcacaggagggaagtgaggacggtcaggcggtacagcttccggcagcgctgacggcgatgctggacaggctggagggtgaactgaggcgtaacacggtaagtgaagagagcaggcagtggctggcgggatgcgggctgacgccggagcagatggcggggcaactggagccggagtacacaccccaaaggaaaatccatctttaccactgcgaccagcgtggcctgccgctggcgctgattgccccggacaacacggtggcgtggcgcggggagtatgatgaatggggtaatctgtcgggtgaggaaaatccggcgcacctggagcaactaatacggctgccgggtcagcagtacgatgaggaatcggggctgtattacaaccggcaccggtattacaatccggggcagggaaggtatatcacgcaggatccgatagggctgaaagggggatggaatttgtatcagtacccattaaatccagtcacggaaatagatccattaggactgaaaatagttattagtggagatcctacagattataacactgctgtggcatacttaaaacaagatcctggaatggcaaaaataatttctgatctggaaaagtcatcaacaacttatacagtctattattatgatggggatggttcattttttgattcgagtgataattctataatttggaacccacatatggctgttaattgtataactaagggaggtttattgtctccagcattggctctcggccatgaattggctcatgccaataaaactaagtttgataaatttctgcgatctattcttccagatgctctctttggtgactatggtaattatgaagaatggcgagttattactggggctgaaagagatgctgcgataactttagatgaacctataagatacgatcactttggccgtgctgttaaagtgccgtcacctagaccaaggtaa

SEQ ID NO: 133 - DNA, 10272 bp, Sorangium cellulosum
atgacgtccgggtggatgaggcgggtatggccgcggtgcgcgggttgcgttctcttgctcatggtgatgagcgcgcccctcggcgcgtgggctcaagcgtcgacgttgcgccggataggcgatcccttccgagcgcggctcaccggcgctcgcggcggagccgagcccgcggcggcgctcgccggggacgccgccgtgctcgcgagcgcggcagaacccgcaggcggcccggacggcctcgccgtggtcccgatggtggccttgccagcggacgttcgcgccgccggcgccggcccgggggcggacccgtgggtcctgttcgacggccgcggcgatacggggcttcgcagcgagaccggggagaaggtgcggatccgggtctcgtttccgcagcccacctcgctcgaggcgctctcgctttacgggcgcagcgagggcgcgctcacggtcagcgcggaggacggcgcggggtttcaggccgtctccggcctcgtcgacgtgccgctccacgacacgggcgagcgctggacgcgccttcccatggcgatcacggcccagcacgtcgtcatcgagtggcttccttcgggcgagcgcgggccgcaagagatcctgttctggaccgccggcgcgcccacgcgcggcctctccgaggtggagctcgccgatcgcgtgctcgccgggcggctcgcgggggcttaccagttcgccgcgacgtccgagcgggccaccgtgacgcgcacgggcggcgagcaatcgctgtcgctccatgtggacaccgatccacgggcgcttgcacgcgcgttcctcgtctaccagctggagggccgcgggcactggtcgagcgtgagccggcagatcaatggcacagcgccgcgcggcggctccccggcggcagcgcccgcgaccggaggcctgcaagtcgaggagatcgcgcccgcgtggctgaggcgcggcgacaacgtggtgcggttccggccctccgccgagcaggagcacggattcaccgtgagcgcgctccgggtggtcgggatcccgcacgccggtgtgatcgaggcgcgttccgctgccgaggcgcgcgcccggccggccggcggcgagcgcgcgcctcgcacggacgcgctgagcctcgatttcggcgcggctgtggcgccgtacgcgctcctcttccagctgaccagcgcgggcgccggggagctccggattgcgcccagcgaaggagcggaggggcttcgcttcgacctgaaggacctgccgccgggctggcaccggttcgatctcccggagtcagcgacatggccgggggcggcctccgtgcagatcacgcctgcgaaggggagccgcgccgaggtgtcggacgtcgccgtggtggcgagccccgtcccgtcccgcgcgcggcggatcgcgctgagcacgccgctgcacggtgagtgcgccgagggaagggcccatgtgcgcgggttcctcgatctggccggcgaagacgcgtcgcgagcacgcctgttcgccggcccggagccggttgcgctgggcgatgacggcagcttcgagctcacgctcccggagcccgagggggcgagtcaccggacgtggacggcgcgcctcgaggcgcggctcgaggacggcacgcgcctcgatcgcgagctagagctcggtccgtgcgccgcgggcgccgcgccgagcgggctcgtcgtggaccacggcgcgccctatggcgcggtggtgagcccggacaagggcgcggtgctctcgttcgcgggcgccacgctcgatatcccgcccgacgcgctggaagagacgacgcgcatcacgatccgcccgctgatgcccgtccaggtgcagccgatggggcgcgcgatgcgcaatgtgacgcccgaggggcgcgcgttccgcttcggcccgcacgggctcaagttcaggaagccggtgaagctgacgttgcctgtcgacgccgcggcgatcccgagcggcgccagggccagggagatcttcggtttctacttcgacgagacggtccagcgatggacgaagctcgggcgcgtcgacgagggcggggcccgggagctcacgagcttgacggatcacttcaccgatttcgtcaacgcggcgatctccatgccggatcagccgggggcgcagtcgttcgatcccaacgcgatgaaggggatccagctcgcgagcccgtccgcgggcgtgtcgttcatcgagccgccggaggcgaacggtcagggcacggcgcagctgtcgttcccgatcgaggtgccaccgggccggcgcggcatcgcgccggatctggcggtcacgtacgagagcgagctgggcaatggctggctcggcgtggggtgggatctgcgcgtctcggcgatcgagatcgacacgcggttcggcgtgccccggtacacgggcgacgagctctacacgctcgacggccagatgctgcgggccatccccgatcagccgggcaggtacgagcggcgcgtcgagggcgcgttcgatcgcatcgagcgcctcggggccgatcacgggagctttcactgggtggtcaccgacaaggacggcacccggtatacctacggcgagagcgcggacgcgcgccttacggaccggtccggcgaggccgggatcttccgctggaacctggagcgggtggaagacacgttcggcaaccggatgcggatctcgtacttcaaggacgcgcccgagggcgaggactgggtgcagctctatccgcagcggatcgactacacggagcacacgagcggcctccctggagcgcactatcacgttgtcttcaccgtggacgacggtgcgcagcggagagacgtggtgagctcggcgcgcgctggcttcgaggtgcggacgacgcggaggctcacgcgcgtcgacgtgaccatgggccaggcgcccggcgccgaggagatcatccggagctatcatttcgcgtacgacacgccggacccgcggcaccatcacaagtcgttgctgaagagcatcgctgtccatggaaacggcggtgaggagatgctctacgagcacggcttcgagtacttcggcctcgagcaagaggacggcgagctccaggtgttctcggcgccgaccgagtggggccgtcccgcggaagggcgcgatggcctcggggccacgagctcggtcgaaggggggctcagcgcgttcgtcggcgtggggccgacggtgtgtgatccgcacgccggggtgggggtctccgtctcgttcggggcggacgacgaggacgtcgcgttcacggacatcaacggcgatgggctcccggatttcgtgggcagcaacggcgtctggctgaactcgctcccggatcggtcgagcggaaacgcgttctcgccggagagcgcgggcagcacgcaccagatcacggtcggtctgcagggggcgatgcacttgttccaggagctcggaggtctcggtgtcaaccgcgcctggagcaccgcgaccgcgcagagcctgctgctcgatatcaacggggacggcttcccggagctgctggatgggagcggggcggcgctgaacccgaacaacgcgcggctcgggccgggcgcccgcggcgccgggttcacgatcgacgaggatttcagcgatggcgagcaggtcgaggccctccgcaacgcgttctaccggaccagcgcgctcgtgaaatgggtgccgccgatcgacgggatcgtcatcatcgacgggggcgtgtcgctggccggggacggcgcgggagacggggtgacggcgtcgatcacgaagacgacgccggcgccgctgccgaatgacaagtttcaccgcgagcaccagctgctctggcagagggatatcgggccgagcgatgctgcgtgtgtccccgagggcgatggggggtgcgggagcggcgtccgcgtccgcgtccgtccgacggatgcgctctatttccgcgtggacccgagggacgacatcgagggcgacgtcacgcgctggaacccgcgcatccgctatacggagctctgcctgctggacacctgccagcggatggttccgcgagaaatgatgcgccccgacgcgctcgggcgcccgctgtacacctataccttcgcggacgatttctccgtgctcgaccggagcgtgcctggctgggccgcgggggcggacgggcaggtcacggtgcaggcgagcttcgtccggaccgacgcgctcgatgcgttcgacgtgcggctcgtgcgccgggacgtcgactcggggcagagcgttgagctccatcggaccagggtgtcgggcgcgcagctcggcaccgagatcgcgtggccggtggccgtgctccagggcgatctcctgttcctgtacgccgagctcggcgagaacgtggtcgacccgtcgcgcgtgcagtaccaggggttcgcccgttacaccgaggtgtgcggccacgacgcggatcctgggagctgccgcgctgtgggcgagtgcgcgcccaggtccggtgctccgtccggaaagagggtttgcgggctcgaagcgtcgcccggcgacggcgggccgatctcggtgcccgaggagtcgatcgtggcgcccgtgcagctgagcgacagcacgatcggcgggacggcgcttccgctgtcgcagctggagcaggtggacgcccgcatggtgggcgggttccgcggcttcagctatggcgagtggacgacggagtacccgttcgacgagaaccagctgaacaagaggccggcggagaacaggccgccttacttcacgcgcgtcgagccgcactgggaggggtaccacgcgagctggtcgccgggcgacgccgggtttcctctcgtgggcagcgtcagcggccctgtgttccggggctcgggcgcggacatgtacatccgggccggggagctcaagccgtcgcgcgtcggcggcgtccggccggaggacgtggccaacgtccccgggctgaggaagagccacaacggctcgggttcggcggagctcgcgctcatcgggtcgttccaggtgacgaccgggaccaccgagtcgaagctggagctcgtcgacgtcaacggcgatggacggcccgatgccgtcacgcagggcggcgtgcgcatccagacgtgcggcagcggcggccggtgcgacgggcagcagccggggcagtatggcgcactgaccctcgaggggccgggggacatccgggtcatcgagaccatgagcgcgcggttcgggttcggcttcggatccgcggcgtccgcgattgcggagaagatcgaggcgagcgccgagaccaaggaggtgctcagcgtgctgccctcgctcggcaagagctggggcacgtcgcagacgacgcgcgacctgctcgacgtgaacggcgatgggctcccggacaaggtgaggagcgcgggcggcgtgctccatgtgcagctgaacctcggctaccgcttcggcgacgagcgcccctgggcgtcgctcgatccgagcggcgatccgttcgagccgctgccggaggtcgacggggatccgctgaccgcgctgagccgggtctggtctccggagaagctctcgtcggtgcgggtgcaggacaacacgacgaacagcctgcaggtgggttatgcggggatcggcggcggcatcgcgcacacggtgagccggacgctcgtcgacttcgtggacctgaacggcgacaggctgcccgaccgggtgatcaagcaacctggacagggctactaccgcgtccgactgaacctcggtgaccgcttcgggcccgaggagaggtggagcgcgccggcggtgagcggcgcgctgccgtggggcgtcgtgctggagaagaagttcacgaaggagatcaacggcagcaacgacgcgctgtcgttctcggagacgacggcgttcaacgcggggtatggcgtgccgatcaagatcccgacgccgtacgtgtgcatcgtgctcgagatcgcggcgcagctcgggttgagcgacggacggagcgagctcgcatgggaggacgtggacggggacgggacggcggatcacgtgctgaagctgagcgaggggatgctgcgcgagcgcgacccggcgcttcgtgcgcggctgaatctgacgggcaagaccaaccggctgtcgcgcgtggtgcgtccgcttggcggcagcatccggctggactatgcgcgtgaggggaacaaggtggcgtatgcgagcagcccgggcgagctgagcgtggacatgcccggcagcaagtgggtgctgtcgcgggtggaggtggacgacgggatgggcacgcccgcgtacgtgcacacgttcgattaccaccagagcgggttttacgaccgggcggagcgggaggactacggctttgcgcaggtgacggcgacgcgcgaggacggctcgcagatcgtgacgcggtaccacaaccaggactattaccggcgcgggctggtggccgaggtgatcgagcaggacgccgaggggcggctgttcagccggcaagaggtggcctatcgcgcgcccggggcgcaggcgacgctgacgggctcgttcttccccggggaagagcagcggacgatgtcgtggtacgagggcaagacgacggacccgagcgcgcctggcaaacagacgagcgaggagcgggactgggacgaccgcggcaacctcacccgggtgatcgagcacggcgagccaggcacgctggaggacgacgtcacgaccacgatccactatgtgacgtacgacgggccgcacgtggtgcgagcggacagcgtggaggcgcgcgacagcgcggggaggctgctgcgcgagcgcaccgccgggtacgacgaggtgaccggggcgttgaagtggatcacgagcacggtgatcgggggcaaggatccggcgacgggcgcgccgtacacgggcgacgcagcgacgaatccaacatgggagttctcgcacgacgcgtacggcaacctggagcgggcgatcgagccgcggggcttcacgctgacgtacgagtacgacgatgtggcggagacgtacctctcccgggtggacgactcgttcggttacttctcggagacgtggtcggactaccgctacggcgcggtgagcgcggtgcgggacgtcaacggccatgaggtccactacgacttcgatgcgttcgggcggctgcgggccgtgttcggtccggacgacccgctggcggcggcggaggcgacgatcgcgttcgagtatgcgctccagtccggggagagcgtcgcgatgccggcgtgggcgcggacgcggcacaaggacgtgcagcacccgggggatccgatcgacacggtgacgttcatcgacgggctggaccgggtgatccagacgaagaaggacctggagaaggacccagggacgggggccgcgcctatcgtgggcatgagcgtgagcggccgggtggtgctggacgagcgggggcgcgtctggcagcaggggcagccggtgttcgcgacgggggaggcgacggcgttcgtggacgtggcgctgaagcacccgacgacgttcgagtacgacgtgctctcgcgcatcgtcgagcggagggagccggacgacgaggccgagggcggcgaggcggtgacgacgacgagctacggtatcgacgagctcgacggcgtggcgatgttcgtggcgacggaggtcgacccgaaggggaaggtgcgcaaggcgtaccaggacgtggacaacgcgatcgtggcggtcgaggagcgcaatcgggtgcgcgggtcggaggcgtggacgacgctgatgacgcggtacgggtacagcgcggtcgacgagctggtgcgggtgacggacacgcgcgggaacgtgacgacggcggcgtacgacacgctgggacggatggtgacgctgacgagcccggacatggggcggacggagtggcgctacgatcggtcgggcaacgtcggtgcgcggcagacggcgaagctcttggcggaaggcgcgaacaagctgatccggtacgagtatgactacaaccggctcaggcgggtgaactacccggactcgacggacgtgacgtatgtgtacggcgcgccggacgaggcgggcgacgagcacggcaaccgggccgggcggctggtggaggagcagagcgaggcggggaagaggacgttctggtacgaccggctggggaacgtggcgaagctgacgacggagttcccccggctgagggagccgcaccgggggccgtaccaggcgacgatggagtacgacttcgacgggttcgggcggctgctgtcgctgaagttccctggctccggggcggaggtggtgacgtacggctacgaccgagggggccttgtccggtcggcggtgggaacgaacacgcagacgaacccgcagcacccggacgagcccgcggtgacgcagtacctgcagcacatcgggtacgacgagttcgagcagcgggtgagggtggtgcacggcaacgggatcgcgacgtcgtatcggtattacgagaagtcgcgacggcttcaggagatcaacgcggaccaccgcgaccggtacctcgcggagcgcgggcggccggcgagggcgttccagcggatgcggtacgagtacgatgtggcgggcaacctggagcgcgtgcggaacgaggtgccgtacgaacaggacatgccgggctcggtgctggtggggccgacgacgcaggagtacgggtacgacgatctgtaccagctgctctcggcgcgcggaacgtaccaggaccggagagactggcagttccggtaccggctgtcgttcgcgtacgacgagattggcaacatcctgacgaaggaccaggcgagctaccggtacgtgccgcaggcgtgtcccacgccggttccggctgggtgcgacggatggcgcgaggatcatgcgatccgggagctgacgtaccggtcggagtaccagtacccgggcccgcagccgcacgcgccgaagcgcatcgaggagcacttggtggcggagtcgatgccgtggccgcgggagatgcggtatgacgcgagcggcaaccagaccggctggacgtaccgtggctcggacacgcggacgacggactggaacgaggagaaccgcgtcacgcgggtgacgcagaacgggcaggtgctgtcgcggatgttgtacgacggcgacggggagcggcgggtgcacctgcaccacgtgagcggtgaggaggagacggcgtaccacgaccagcacctgacgctgcgggacgggcggtttgtcacgaagcacatctatgcggggcagacgcggatagcgagcaagatggatccggactggttccgtgacccgccgacgctgtactaccacccggaccacctgggcagcacgagcttcgcgtcgaacaacgagcagacgctgacgcagcgggacgagtacttcccgagcggagagctgtggatagacgcgtcggactcgcggtacgagctgaggcgagcgtacgtgttcacgggcaaggagctcgaccaggcgacggggctgtactacttcggggcgcggtactacgacccgagaagcagtgtgtggctgagcccggatccgatcctggacgagtacatggacggagggacgagcggaggggtgttcaacccggggaacctcgggctttacagctacacgctgaacaacccggtgaacctggtcgacccggatgggcggcaggcgcaaggggggcaccggaacttcccgcctggtagcaatggcgagcggagcccgaatggctggtacggacctgaggccgctcgttataaccagataatacaggcacagcgcatcgcggagcagcaggcgcagggtaaggtacccacgagctcagcgcctgcgccggtgcctccgcctgctgcccagcagcgggcgccctcgtcgcccccaccgccgccggcgcagccaccgcggccagcaccgccagcacagccggcgaaggcagccgcggcggcgcagccagcgaagccggcgcaggcggcaccgcccgcaaagccgatgccggcgacagcgaagcagccggagtcacccacaggatctgcaaaaggtggagcaggaggtgaacgcgcagggagaaatttcacacgagctggaaaagctgcagtcaagtccgcgaacgctgcggcaaatgccggtcagactacatgcactagctgcggtcaacctaccgtcccggctcagcagagccggacgggggtgacacctccaaagaacgaaacgcatgtcgatcacatcatcccgaagattaagaacggaaacggttcccctaacaatgggcaggtgctctgtcgtgattgcaatctccgcaaaggacctcgctga

SEQ ID NO: 134 - DNA, 9450 bp, Sorangium cellulosum
atgccgctgtcgccaccaggcggcggggcagcgctctcttcgattcccttccagttgccgagcgacggtgtcggggggctgtccctggggcctcgggtcgatgcgccgccggtcgaggacgtgggggcgccgttcggcgagatggtggtgcccgacgaggcgcgggtggtggcgttcgagggggccgtgctggagatccctcgaggcgcggtggacgagccggtgcggatcacgattcgcccgctcgaccagggcgaggtgcgtccgatggggcgcgcgatggtcaacgtcacgcctggggcgagggcgtaccggttcgggccgcacgggctcagattcaagaagccggtgcggctgacgttgccttacgacgagcacgcgatccccccggggatgacagcgcagcacgtgacgggcttctacttcgacgaggcgctgggccagtgggagcgcgtcgcgcgggacggcgaggccgcaaagggcaagctggcgagcctgaccgacaacttcaccgacttcgtgaatgccacgctcgcgatgccggacgcgccgggcacgcgcagcttcgatccgaacagcatcaaggggctcgcgctggggagcccgttcgccgcggtgacggtggtcgcgccgccggaggcgagctccagcggcgctgcgcggctgagtcatgcgatcgaggtgccgccggggcgcaacgggatcgagccggcgctcgcgatcgcgtacgacagcgagcaccgcaacggttggctcggcgtggggtgggatctgaggctgtcgagcatcgagatcgacacgcgcttcggggtgccggcgtacgcggcgggtgaggcgccgcgctacctgctcgacgggagcgagctcgtgcaagtcgaaggcggcgcctgcggcgacccgtgcctgttccggcggcgggtggaagggcggttcgaccgcatcgtgcggcacggcaccggggcggccagctacttctgggaggtgacggacaaggacgggacaacggctgtctatggccgcgacgcgaacgcgcggctcgacgatcccgagccggcaccgggccagccgcgcaacgtgttccgctggtacctcgacgaggtgcgcgacacgttcggcaaccagatgcgggtccgctacgatcgggagatcgagcccggtccgccgccgcgcatcgaggtgcaccccgagcgcatcgagtacacggcgaacgcgtcacgaggggtcgaagcggcctatgccgtggacttcgtgtccgagggcgggcggcccgacgtcatgctcagcggcaggcccggctttctcgagcagaccgaaaagcagctctcgcgtgtggacgtgcggttcggcgacgtcgtggtccgcagctacgcgctccattacatcgacggcgatttcggcaagcgcctgctgcaggccatcgcgttccacgggcgaggcgcgcggcaggcgggcgggcaggtgacggtcggcgaggagctgtaccggcatacgttcgagtacttcacggcgcctcgcaccgcgtccggcgaggtggcggcgttcgcgcaggcggccgaggtatggggacaggccaaggcgagaagcggcctgtcgcgcacggaggactcgaccgcgggcggcagcgcgtcggtggggctcggcatcggcatgttctcgatctcggtcggcgggggcggcttcttcggcgacgagacggtgcgcaagagcgtgttcgacctcaacggcgatgggatgcccgacttcctggaggacagcggcgatgtcgggctcaacctgcttcgcgcggcgtccgggaaccatgtgacggcggcgagcgcgctgggcttgttcgacagggatctcggcctgacggaccgctcgggatggagcgtctatgcggggctgaacgtcgcggcgctgagcggctcggtggggtacacgcggagcagcacggaggacgagcagatcgtcacggacatcaacggcgacggctaccccgatctggtgtcgggcggcccgctcgggggcgtctacgccgcgctcaacgaccggcgaggccgcttcgggagcaagcagccgtggggcgcgctcgacacgagcggcgcgccgtccggccgtcccgacctggcccaggcggcgcgcaaggacctgcatccggccgatccgctgctgcgctggatcgcgccgttcgagggagacatccgcatcggcggagcgctgcagaagcaggaggcgggcggcgatggggtgcgggtgcagatcgtgcggagcggagaggaagagccgctcttcgacgatgtgctcgacggggacgagctgactccgtgcctccttggcgcgcatcggtgcggcggcgatgtcctcacgacacatgtggccgcgggcgaccggatctacttccgggtgagcgcggcgccggcgatcgaccccgagcggcgcgtggacacggcggctgacctgatctcgtggagcccgtcgatcacctacgacgtgagcgaggcgcagctcgcgcaggcggggccggacggggcgccgatccaccgcttcgagtacagccacgaccaccggctcgcggggcgcccagacgtgccgtgggtggcgccggccgacggcagcgtccggatcacgggcgacctcacgaagtgggcgacgagcgatgagctgtgggtggagatcgtgcgggagcgcggcagcgccgcggcggagtcgatcctggcgccgcagcacgtcggcgcgggcgccggcgggctcgggctgggcgcgctgcttcccgaggcgatcccggtgctcgcgggcgatcgcctccggttccgggtgaaggcggagctgcccgatgacccggcgcgcatcgcatggagcccggtggttcgctacgaggagtacacacgcgtggaccgggcgacgggcgcgccgcggcgcgggcaagtgcagtgcagcgcgcagccgaatggccgtaccggctgcacgctgcacaacgatggacccggggacgggccgctgccgctcgcgctcatcgagcagcgggcgcatgtgtcgatgcctgtcgcgaggtggtcgcatgcgacgcgcccgcggccgtggatcgcgccgagcacggggacggcgcggctcgagggattgctgctcgtgccggggacctatacattcactcagccgttgaccctggtcgtgcagggcgtgcatcggctgctcttcaagcaggcgtattccgcgccgagcgctgccgggacggcattccccgtggacatcgacctggaggtccaggccggcgagccgatcttcgtcacggccttcgcgcaggtgccgcccacgggcgccgcgctgaacgcgacgatcgacggggagccggtgtcgctcggcgtcttcgcgcccgaggcggcggcgagcgccgggtcagaggacccgatggccggcgggttccatggctggtcggtcggcttcctcgatggagatcgcgcgttctcggaggcggacatcgcctttccgacgctccacccggagcgcggcttcacgctcgcggtgccgctgccacaggggagcgcgccggtgtggggcgcggccgcgtcggaggcgttcgtcgggggcagttcggtcaaaccgtcgatcgtgggcaaggtgaggcggggagacggtcagctcggccggctgcgcagcgcggagacgtggaacgcggagatcagcgccaacctcgggccactgggggcgggctacagcttcggcagcaccacgtcggacctggacctcatcgacatcaacggcgatcgattgcccgacagcgtgacgcgcgagggcgcggtgctcaatacggggcgagggttcgggccgcgggacagctggtcgctgccggaggcgctgcggcggatcgagcaccgtgcgatccggctggaagggagcgcatcggtcactgtcgacagcgagatccagacgatctccaagaccacgagcgaggggcgcttcgaggggtacctgcacacgcaattccgcgttgggacgagctacggcctgtctgccacgcacgtggatcttgtggacgtcaacggcgacggtctggtggaccaggtgacgcaggatccccagagcggggtgatgaaggtggcgttcaacctggggcatcggttctcggggccggcgccgctggagcgggcgcgcttcgaaaagagcgacttcaacgcggggacgctgcgcgagacgctcggcgacatcttgagcgagttcacggacgcggccggggtggacgctgtgcggctggaggacacgggcgcgaacagcgtcggcgtcggcgtggacgcgaccgtggccgccgccggcgcggggtacacgtacacgacggcgcggacggtggtggacttcgcggacgtgaacggcgacgggctgccggacaaggtgatgaaggacccggaagagccgtggttccgggtgcagctcaacctcgggagccggttcgcgccggaggagtcctggcccgcgggggcgtggggcgtgtcgatcgatccgccggagtacgcgttcatgggcgggggcgacgcggtgagcttccgcaggtcggagagctacgagggcagcttcaaggtcgatgtctgctacttcgtgtgcgtcggcgggtcggtgttctactcggaaggcgccggctcatcgcacctcgcgttcgaggacatcgacggcgatgggcttcaagatcacgtgctcaagcgggacggcgacgcgacggtgtacgcgcgggtgaacgcgctcggcaagacgaacctcttgcggcgggtgagccggccgctcggcgggggcatcgagctggactaccggcgcgagggcaacctggtcgtgccgagcgaaggggcgctcggggagatggatagggcacctcaggtcgacatgccgtcgagccagtgggtgctgagcgaggtgacggtgcacgacggcgtggagggagcgccgggggtgtacggggtgcatgcgtaccggacgagcttcgcgacgcacgcggatggggtctacgaccgggaggagcgggtcgagctcgggtacgggctcgtgacgacgacggcgctcggcgaggatggcgtcacggcgatgtcgagcgaggacgtcgagcatctgaaccacgacgtctaccgccgcgggttggtcgcgcgctcgacgctgcgcgacggcgacgggctgctctatacggtgaacgaggtcgactacgcgccgccgccccaggggctggagcccgggatgggctggttcttccccagggagacggagaggaggagcgcgttctacgaggggacgaccgacgacccgagcgcgccgcacaagagcacgcgcgagacaagggtcttcgacgagctcggcaacctgatcgcgctgcacgccgacggcgaggccgatacgccggacgacaacgtgcatcagcgggtggagtacacggagcctggctcggcttacatcgtgaagccggagctcgtcgagacgaccgatgagcagggtcgcgtgctgcgccggcgaacggcgacgtactggccggggacgggcgcgctgcggacggtcacgaacgtcatctccggcggcaaacgggcggatgggacgacttacgcgaacgcggaggccacgtggagctatgtgttcgacgatttcggcaacctcgagacatcgaccgacccgaacaattacaagctgacgtacagctatgatgaggtgacgcacagctaccgcacgtgcgcgagcgatagcttcggctaccgttcgaacagcgtgccgaatctgctgtatggcacggtggcgcaggagaccgacgtcaacgggcacacgatggtgcaccgggtggacgacttcgggcggctcaccgaggtctgggcgccgagcgacctggcggaggacggcgaggacgccgggccggtcgggtgcacgccaacgacggtgtacgatccggaagcgctcgtgggcgagggcgagccgacgatcgggttcgagtacgcgctccagcccgaccagaccgccgcgctgccggcgtgggcgaagacgagccacaaggacgtggagcacccgggcgatccgatcgtgacgatgacgttcgcggatgggctggggcgcgtgctgcagaccaagaaggaccacgagcgggacacgggcacgggcaccgaggtcgggatgacggtcagcggggcggtggcgttcgacgcgctcggccgcgtggtggagcaggggcagccgggcttcagcgcggagccggacacggcgttcgtgagcctggcgctgctgcggccgacgctcacgcgttacgacgcggtctcgcgtgtgcgggaggtcgccatgccggacacgagcgcgctggacggttacgcgcggacggcgatcgagcacgacctggtggcgctggaaggacggctgctctttcaggagatggtgatcgacgccaacgcgaagatgcggaacacgtaccgggacgtgggtgggcggatcgcggcggtggaggagttcaaccggatccagggggtggagacgcggatcgtgacgcgttaccagcacagccccctcggggagctcgtgcgggtgacggacgcgcggaacaacgcgacaacggcgacgtacgactcggtgggccggatggtgacgctggtgagccccgacgcgggccgcacggagtggcgctacgatctggtcgggaaccttcgggcgaagcagacggcggagctcgcggcgcaggggcagctgatccggtacgagtacgacttcaaccggctgcggaagatcgactatccggtgacgcaggacgttgtctacacgtacggcgagccggacgacgccggggatgagcaaggcaaccgagcggcgcggctggtggaggagacgagcgcggcgggcaagcggagcttccgttacgatcggttcggcaacacggcggagctgacctcggagttcccgcggctgcgggagccgcatagggggccgtaccaggcgacgatgaagtacgtgttcgacgcgctgggacggatgcaggagctccacttccccggctcgggcgaggagatcgtgcgctacgggtacgaccgcggcggcgcggtggtgtcggtggtcggggagaaccagcgcgtcaatccgcagcacccgagcgagccgaggacgacggagtacctgaggcacatcgggtacgatgagttcgggcagcgggtgcgtgtggtggcgggcaacgggatcgagacgaagtaccggtacgacgagtcgacgcggcggatgacggaggtcaacgccgaccaccagagcgcgcagatgcggtcgatggggcgatcgccgaggccgttccagcggctgcgctaccggtatgacctcgtcggcaacatccgggagctgaacaacgaggtgcctttcgacgagtcgctgggcggggccgtcatggtggcgcggacgcagcagcggttcgcgtacgacgacctgaaccagctgacggaggcgtcggggatctaccaggagcggggaaacgagcagcagcggtacacgctgggcgtcgactacgacgtcctcgggaacgcgacggcgaagcggcaggaggtcgcccagtacgggcgggtcgggggtaacaactggcagatgcagtatccgatccgggagaggacgtaccggaacgactaccgttacaccgggccgaggccacacgcagcgaaccaggtggacgagtacgtgccggcggagtcgcagccgcggctgagggagctgttctacgacgcgaacggcaaccacaagcagtggaagtaccggggcaacctgcagcgcacgctgagctgggacgaggacaaccggctggtgtcggtgagcgagaacgggcaggagatgtcgcgggcgctgtacgacggggcgggcgagcggcgggtccacctgcaccgggtcgccggggaggaggagacggcgtacgtcgatcagcacctcgtggtgcgcaacggggtgatcgcgacgaagcacctgttcgcgggggagacgcggatcgcgagcaagatcgacgcggactactaccagaggccgccggtcttgtactaccacccggaccacctcgggagcacgcagtacgtcaccgaccaggaccaggcgctgagccagcacgtggagtacctgccgagcggggagctgtgggcggatcagacggactcgcgataccagaacaggcagccgtacctgttcaccgggaaggagctcgacctgtcgacggggctctaccactacggggcgcggagctatgagccacggctcggggtgtggatgagcccggatccgatcctcgaccagtacatgcgaggggcgccgaacggtggggtgtacgagccgattcacctggggctgtacacgtacacgcgtaacaatcccctgaggttcgttgacccgaccgggatgagtgagacatgcgccggtggcggttgcgagtcgtatgcgggagcgttggactccgaggcgcagagtgtcgatccagccgctaccgaatgcacctccggcggatgcatgagcatgagccctacgatcgctcagctgaacgatataagccgatctcaggttgcgagggcgcacgcggaacagatcagcagggcagatgtgcccatagagacctcgctggtcgatccgattgacctcgtgggcgctggcggcggaatcaaagtactttggaaagcaggaagtagggcgctcaccaaattggccacgcggcagaccttagcgaaagcggaagctctggcagcaaggggagccggcggtttgtgcttcgcggccgggacacctgtacagaccgaagacgggctcaggcctatcgagaaggttcggccaggagacgttgtgtgggcccaggacgaggtcactggcgagatagcactacgacgggtcgtgcgcactttcgtaacgcccgatcaacccgtggtcgaagtcgtacttgaagacgatgacggccaggcagagagcatccgctcgacagtcgagcacccgttctggacacagcgaggttgggtaggcgcacggcagctcactagccgcgatcgcgtacttcagcgttcggggacgtggtcgcgggtagtgaccgtcagcgagaccggtgagagtgtcaccgtctacaacttcgaggtggagcagtttcacacgtacttcgtgggcgagcgtggtgtgctcgtgcacaacaactcagacatttacgccgcagcgcgccaggcaattgggacggtctccgggagcctgttcaagcctttacaatgcgtgcagtgcgcgagtgcgatggctaatgccttgaaagctcgaggaattccggggcaggtactgcaaattcgtgccaaggctggcgagttcattgctagcgatctcgtcaagtcgggcacgaccagcatcacccggaacggctaccacgaggccgtccgcgtcggggacatcgttttcgataacttctttcccggaggcgttccatatcagacctacgtagactcgctgcacgcgatcggtggtgtggcaatcaaagctgttgggttttga

SEQ ID NO: 135 - DNA, 4479 bp, Streptomyces bingchenggensis
atggcagacacggacgcggtgcggcccccgcagatacggataccggtgggcgcgaagcccaaggacctgatcccaggcaatcccgccgacgttgacgacctggtgctggagctacgcgcgtatgcgggcgctttccaggatggcaaggacaagctgaggccggcggatctggaggattggcagggcaggggcgcgggcgagttcaggaaggccgtcgaccggctgccgaaggaactgacctcgggccacgaccagttcacgcacgcggcgagtgcgctggcgtcgtacgcgaccaagctgcggtcggtgcagaagcgctgtgagccgatcatcgaggacgcggacgcggcgcgggctgcgtccaaggcgcaccacaagaaggtcaatgcctacgacgacgcggtgacgcgcggcgatgagcagctgccggagaaaccttcggagaccgatccgggtatctccgcgatggaggactgcatcggccggctggacaagctggtcgccgagttacagctggtcgtcgacgcgtcgaagaagaagatcgacaaggcgacggagaaggccccgaacaagccgagcaactggcagaagttcggcgagggcgtcaaagacgggctgtggaaggcccactatggcatcctcggcctggccgagctccccgcctcgctgctcaaaggtgacctcggcggcttcagcatgcagctggccggcatggtggacggcgcggcgtacgcggcgcagcacccgaaggagttcgcgaaggcggcccttaactgggagatgtggtccaaggacccgctgcgcgcggcgggtgagatcaccccggagctgctgctcgccgtggccacgggcggttcgagcgtgctgcgcaagaagctggacacgggcgcgggcgcggccgagcgtctggcggcccgtaagaaggcgctgggccgggacggcgaggcgcacgaccgggcgaaccgcaagggcacgcacgaccagtgcggagctgagaagaagcagtgcggcgacccggtcgacgtggtgacgggtgagatggtcatgccggccacggatgtgtccctgcccggggcgctgccgctggtgctggagcggacctttgtctccggccatacctgcggcggctggttcggccgcacctggtccgccacccttgaccagcggctggagctggacgccgatgggatcgtgttcgtcgcggccgagggcatggtgctgcgctatggagtccctcaccccgaacaggacatctacccggtgcggggtccgcgctggccgctgcgctgggacggcacggcgggcggcacgatgcggatcgagatcccagagcaggcccgcaccctgcacttcacgcccctggccgccgacggcaacgagctccccctccaaaggatcgaggaccgcaacggccggtccatcaccttcacctacgacgcggacggcaccccccgcgaagcagttcattccggcggctaccacatcgccatcgacaccgaccccgagctgctgcgcatcaccgcgctgcgtctgctgggcgtcggtgacgccgaggcgggcaccacgctagtctccttcggctacaacggcgcgggcgacctgaccgaggtcttcaactccgcggacgagccgatgcggttcacctacgacgaccagcaccgcatcacagcctggaccgaccgcaacggcaccagcttcgggtacgtctacgaccaccggggccgcgtgctgcgcaccatcggctcggacaacatgatgaccggccgcttccactacgacgaggccgcccgcaccaccgtctacaccgactcactgggcaaccggtccacctacgtctacaacgaggcgggcaaggtggtgaccgagaccgatccgctgggcaacaccacccgcacccagtgggatccgcagaccaatcgccttcctctgtcggtgaccgacccgctgggccacaccacgcgctacacctacgacgacgcccacaacctcatacgcgtcgaacgcccggatggcacggcagccacagccacctacaacgagcacggccagccgctggagatccacgaacccgacgacgcgacctggctccacacatacgacacccgaggcaaccgcaccaggacgacggatcccacaggcgccgccacccactacacgtacgacgactcgggcaacctgacctccgtcaccgacccgctcggccacaccacgaatgtcgtgtgcaacaaggcgggcctgccggtcgaggtcaccgacccgctgggcaacacgaccaccatccgccggggaacccacggccgcataacccgcgtcaccgaccccctgggccatgtcacccgccagggctggaccatcgagggcaagccctcctggcgcgcccgccccgacggcacccgcgaaacctggacctgggacgccgagggcaacctcgtcgaacacaccgacccggcgggcaacaccacccgccacacccacacccacttcgacctccccgcgacccgcaccgaccccgacggcgccacgtacgccttcacgtacgacaccgagctacgcctgacggcggtcacgaacccccagggccggacgtggacgtatgcctacaacggcgcaggccacctcgcctccgaaacggacttcaacggccgcacgctcacctacgagcacgacgcggcgggccgcctgatatcccgggagaacggcgcaggcgaaaccctcgcctacacccgcgacacactgggccgcacgatcacctcgcgcacggcggacggcactgagacgacattcgcctacgacgcggcgggccgcctgacgcaggcggcgaacccggacacggagctgcgacgcacgtatgacgcgcggggcggggtcctcaccgaaacggtcaacgacaagaccacgacctacacctacgaccaggcaggtaaccgcaccgcacgcactacgcccacgggcctgcggtcggagtgggcctacgacgccactggccgcgtcacgtccctcaccacggcggacaattccctgcgcttcgcctatgacgcggcgggccgcgagacatcgcgcacgctcggcgacgacgtaagcctgacccaggcctgggacgccctggaccgcctgacgacccagaccctcacccgcggcaacacgtccacgctgctccagcaccgggagtacgcctaccgccaggacgaccacctcaccgaaatccgagagctgacctccggcacccgccgcttcgacctcgaccaggtcggccgcgtcagggcggtccacgcccacggctggaccgagacctacgcctacgacagcgcaggcaacctcccccacgccaccgccccaggccacgaagcctccggcgaccgcgagttcaccggcacgatcatccatcgcgccggccgcaccacctacgaacacgacgcccagggccgcctgacccgccgcacccgcaaactcctcaacggccagacccgcacctggacctacacctggaacgccgaagaccgcctcaccaaggccaccacccccgacggtgaacactggcactacacctacgacccactcggccgccgcaccaccaaacaacgcctggcccaggacggcacagccgccgaccagatccacttcgcctgggacggcacccgcctggccgaacaaacgacaatggatggggccgtaacaacctgggactactccccaggaacccaccgccccatatcccaaaccgagcaccactcgtcacgtgaagtggttgagaagacaccctcaatcctccacctgacggacaccaccccccaatcggagtacgacacccgcttccacgccatcatcaccgacctcgtcggcacccccaccgaactggtcaccgccgacggcaccctcgcctggcaacaccgcaccaccctctggggcactctcctccccaccccacccggcacagccgactgccccctccgcttccccggccaatacgccgaccccgaaaccggcctccactacaactacttccgccactacgaccccgaaaacgcccgctacacctcacccgaccctctcgggctgagcccaggcccgaatcattacgactatgtcagcaacccgaatgtttggatcgatcccttcgggctggcgccggaaggctgcacgtccgctgatcctcacgcactgaaaccgacgcacgaaataagtgggaactcttcaaccaagcgggttaagaaaatgatggatgacatgcggaacggaactttcgattgggagcaaagcccaatttctgttgttaaagatgacgacggaaccatgtatgtggttgatggacatcacagactagcagcggcgaggcgaatcaatctcgacgaagtggcaattcgcgatgtcacgcagcaactcaaggacggcgagctaccgggatacaaggacatagatgatgtaacatcgtccgcatcagaatatagggggaataggttgaaccaatacaaattgaggtga

SEQ ID NO: 136 - DNA, 6798 bp, Streptomyces clavuligerus
ttgccgggagtaccgtcggccgagaagccggtcgccggcagcttcggcaccgcgtccgttccccgggcctcctggcgcggacctcagggaccgcagcagcagccgcgggcctcctggcccgccccgggccgtaccacggtcgccgtgtccgaccccggggtccccggcgccgcacggtccgccactgcccggagcggtccgatccggatcacccccgcagctctcgatcccgcacagaagcagcggagcacgcggaccgcggggcaggccgcacccaggaccgtcgagacccggatactcgaccggaagcagaccgaacgcgccggagtcaagggcgtcctcttcaccgtggcccccggccccggcaccacagcggcgcggaccgctccggtcggggtcaccctggactacgcggacttcgccggagcgttcggcggctcctacgcctcccgtctgcgcctggtgcaactccccgcctgcgcgctgaccacccccgccaaggacgcctgccgcacggagaccccgctggcgggcaagaacgacacggtccgtcagaccctgacggcgaagtccgtcggcatgcgcctcggggcggcgaccgtcctggccgccgtggcggcacccgagggcgacaagggcacctacaaggccacctcactggcctcttccgcatcctggagcaccaacctcaacaccggtgacttcacctggtcctacggcatgcccgtgcccggtgtgccgggtgaactggcaccgaaggtcgggctccactactcctcgggttccatcgacgggcgcaccggcaactcgaacaatcaggcgtcctgggtcggtgacggcttcgaactgtcaccgggctccatcgagcgccggtacaagccgtgctcagaggacggggccgagaacgccgacggcagcaagcccggggatctgtgctgggcctacgacaacgcgttcctctccttcaacggcaagggcggcgagctcgtcccggtcgacctgaaggccggcaccttcaagatcaagaacgacgacggcaccaaggtccagcgtctctacgacaccaaccgggccaacggtgacaaggacggcgagtactggctcctcaccacgccggacggcaccgagtaccacttcgggtacaaccggctccccggctggaccacgggcaaggacaccaccaactcgacctggaccgttcccgtcttcggcaacgacacgggcgagatgtgcaagggcaccgacttcgcctcctcctggtgccagcagggctggcggtggaacctcgactatgtccgtgacccccacggcaatgtcatcacctaccactacggcaaggaggagaactcctacggccgtaatctgaaagaggcggacgacaccccctacacccggggcggctacctcaagcggatcgactacggtctgaagtccgaccgggtctacaccgacaagcccctcgcgcaggtcgtcttcgacagcgacgagcggtgtctgccggagacaggggtcacctgtctcccggacaccatcaaggacaagtcgttctactggtacgacacgccctgggacctgaactgcgccgcgggcaccacgtgcgacaaggggcggctctccccgtccttctggacccggaagaggctgacgcaggtcaccacccagactctcaacgcgggcggcacctacgacaagcacgacagctggaagctgggacaccgctggggcaagccggacgtcgactaccagctcatcctcaccgacatccagcgcacagggcacaccgcgacccccgccgtgaccctgccgaggaccaccctcgcctacacccagctggagaaccgtctcgacaagaccggtgacggctacgctccgttcgtcaaggagcggctgtccaccgtcgacgacgagacgggtggcaaggtcagcgccaactactcggccgccgcgtgcgactggaacgccctgccgaccccgcagtccaacaccacccgctgcttcccccagtatctgggcggtgacaacgtcgccgcggcggagctccactggttcaacaaatatgtcgtcacctccgccaccaccacggacaggagcggcggcgcgcccgacgcggtgacgcgctaccagtatctgggtgacgcggcctgggccttcgacaagggcgacggcctgagcaaggagaaggaacggacctggtcccagtggcgcggatacggacacgtccgcgtacagaccggaggccagggcggcaccgccgccatgaagtcgcagcgcgacactcactatctgaggggtatggacggtgaccgcgcgggagtgaaggaggaggacggcaagaagacggtgaccgtccaactgggcgagggcgaaggaaccccgatcaccgaccatgagtcgctctccgggttcagctacaagacggtcaccttcgacaagcccgggggcaagatcctggcgaagaccgtcagcaggccctggcaccacgaaaccggcaagaaggaccggacctggggcacggtgaccgcgaacctcaccggaaacgcgcaggtcaagggctgggagtcgatcgacgacggggcaggtgccaagtggcgcacctacaccaccgacaacacctacgacacggtcgcgggccgactggtcaaggtcgacgacttcggtgacgacacgaccgccgaggacgaccagtgcgtccgtaccacctaccccgcgggcacacccgccatcctgagcctgccctcccgcgtggagacggtcgccaaggcgtgcgccgcgtcgaccgaccgcaccaaggacgtcatcaccgatgtccgcaccgcctacgacggcaaggcgtatgacgccgccccggtgaagggcgatgtcacggccacagccgttctgaagaagcgggacgccgcccaggcggtctacctggagacgggttccacctacgacgggtacgggcgtgtgctcaccagcacggacctgaccgccgatgtcaccgttcccaccggcaaggcgcccacgcgcacggcacgcaccgacggtcgcaccagcaccaccgtctacaccccggcgaccgggctgcccacacaggtcaagacgaccaccccgccggcggacaccaaggtcccgggcagtgcgcagacgtcgacccaggacttcggcgcacgtggtctgccggtgcggagcaccgacaccaacggcaatgtgaccgagcagcactatgacgcactcggccgcaattccaaggtctggctcgccgaccggcgcaccaccgacctgccgagccatgagttcgcctatcacatccaggacggcaagccctcggtcgtcatcagcaagaccatcgacaacaaccagggacagatctcgtcacgggtcctgtacgacggttttctgcgggagcgccagtcccagtcgcccggtccggacggcgggaccattctgaccgacgtcttctacgacgaacgtggcaacgcggtgaagtccttcgcgccgtactacacgacgcagaaggcgaagctcgaactcttcaccccggatgaggcgctgtcggtcgagacccagacccacacgacctacgacggcctcggccgccagacccaggtgcgccagatcgccggaaacggtgatggcggcgccgttctgtccaccagtaccaccacctatgggggcgaccgcaccaccgtcgttccgccggacggtggaaccaccatcaccaacatcctcgacggacgaggccgtatcgccgaggtacgccagcaccacgagcgctccgcggactccgcgtacgactcgacccgctacaagtacaccccgagcggccagctcgccacactgaccagcccctccggtgccgtctggcggtacgtccacgaccagctcggccgcaccatcgagtccagcgacccggacaagggcatcgtcaagagcagctacgacgaccgtgggcaactgctctcgacgaccgacgcacgacagcagtccctccaccacatctacgacaacctcggacggaagaccgaggtgcgggagggcagcgccaccgggaaggcccgtgccaagtgggtgtacgacaccgtcgcccaggccaagggacagctcgccgagtccatccgctaccacaaggaccaggcatacagctccaaggtcatcgcctatgaccggctgtaccgtccggtccggagcgccgtcgtcatccccgaggccgagggggtcctcaagggcacctaccagaacgccacggccttcaaaccgtccggactgccggcgtccatcagctactccgccgccggcgcactgcccggcggggcggtcgtcaccacgtacgacgacattctgcggccggtgggtgtcacgggcgacgggatgtccgcgagtgtcatccacagcctgaccggcaagcccctccagtacacgatgaaccggagcggcggaaagaaagtccaggtcaccaataccttcgagtggggaacccagcggctcgccacctcacgtgtcgaccgtgaggagcagaacggcgtcgaccgccatgtcacctatcggtacgacgacgcgggcaacgtccggtcgatggccgacgtctcccgcaccggcaccgacaaccagtgcttcgcctacgaccacctcacccgtctgacggaggcgtggacccagtccgccaccacctgtgccgccgctccggcgtcggacaagatcggtggtccggccccgtactggcacagctaccgctacaacaaggccagcaaccgcaccacggagacactgcacgacaccacgggtcagccggccaaggacatcacccgcagctacacctaccccgaggcggggcagccccggccgcacagtgtcctctcggtcaccagcagcggtccggctccgacgaccctgaactacggctatgacgacgtcggcaacacccagacccgtcccggccagaaactcgaatgggacgtggagggccgactcaccaaggtcaccgaaggcaccaagaccacggagtacgtgtacgacgccgacggcaaccggctcatcgggcgcaccccgaccgagacgaccctctacctcggccacaccgaaatcacactgcccaagggcgccacggcggccaaggccacgcgctacgtccccatcggcggtggccacaccgcggtgcaggacaacgaccgcagccacacattcaccatcgccgaccaccatggcaccggccaactggccgtcaaggccgccgacctgagcgtgagccagcgccgcagccttcccttcggcggtccccggggggacgccccggcgtcctggcccggcagcaaggggttcgtgggcggcaccgacgacaccaagtcgaccggcctcacccatctcggcgcccgcgagtacgacccgtccatcggccggttcatcagcgccgacccactgctccagaccagcatcccgcacaccctcaacggctacagctacgccgcgcagaaccccatgaccagctccgaccccagcggcatgggcgtacccgaatgccacagcggagccctctccaagtgccagaacggcgcgcccaccaaggaatcgaagtaccacccggaacgagagccgaagacctgcacgtccaactgctacagcgggccggaagcgggcagcggtggcggtggcggcggacacagagccgcggccagcatgggtggcggcggcggtggcggtggcggtggcggttggagcatctcctccgcggcgaagagcgtctggaacaagggcgcggctcttgtcgagcaagccgtcgagatccccggggaggccacctacggactcgtctccagcgcggcctacacctccgaactcttcggctggaccttcgacggcgactgctggaacggtggcgccggcgcggcgggctgtgattacgggacccagtgggacaactggatcggggagcagggggtcgacacctccagcgtcacctatcagatagccgggctcgtgggctcgctggtgtcccgcaggccgacgggggccaagcccggtcccaagcgcaaccctgactgcaaggggagctccttcgtcgctggcaccgaagtgctcatggccgatggcacggccaagaacattgaagacgtgcaggtcggcgacatggtcatggccctggacccggaaacgggcgagtgggccgcgcgccaggtcacccatctcatccgcagccagggcgacaagcagctcgctgagctgtccatcgcgacggatgacggcatcgagccactcaccgcgacggacaaccaccccttctggtccccgtccgaacgccgctggatcgacgccgcggatctgaccgcgggcatgacgctcctcacggacagcggtacgaccgtcctggtgacggccaaccgtgcccgtacggagcggatcagggtctacaacctgacggtggatggccttcacacgtactatgtgctggcgggtggcactccggttctggtccacaactgcggtggagctgttcaaagccacccttcgagatgtaattgcgccaatggtgacgtaccgaaggtgcggaacggtaaacttgctggaagcgtccatccaaatacgggtgttccgttcgacgcgcagggatttcccgacttttcggcgtggcgtcatccacaggttccagatgttcgaatccagctcaccggtagtcgatctagagacttcaggcttgccaaccaagcggcagggttgccttcaacgccaacaggctacacatggcaccatcatcaggatcgtggtctcatgcagctcattgataggcaagtgcatgccgacaccggacatactgggggtttctga

SEQ ID NO: 137 - DNA, 6915 bp, Streptomyces griseoflavus
gtgcccacggtggcgttggcgctgctggccccagtcggtcagctgccggccgcgatggccgacgagcagggactggggcgtcctgatgtgcccaaaccccgcgtgagcaaggtcgaagaagtcaagggtctgggtgcgaagaaggcacgccagaaggtctccgagggcaagaaggctggcgaactgcgggcccgcaaggccaagaaagagcagacagctgcctggcccaagcccgacacggccaccacgacactctccgcgaacaaagcggccaaggtggacctcgcgggaacgcctgttgccgcgcagccggtcaagagccggagcatgccggcggccgcagggtccgtagacttcacggtcctcgaccagaatgcagcccgcaagaccggcatcaccggtgtgctcttcacagccagcgccgacaccgccggaacggcggaagtcagcgttgactacagtgtcttcgcatccgtgatcggtggcggctggtcggagcgcctgcgtctcgtgcagctccctgcctgtgcactgacaactccgtcaaagacggcgtgccgcaagcagacccagctctcctcagccaacgacttcgcacagcagaccgtctctgcgcaggtcccgcttgctgagaccacatccggcgcctccacgcagctttcctcggcgaacggactcaacaatttcaccgtgtttgcggtgacggcggcggctgccggagcggggcagacacccaaggggaccggcgattactccgcaaccggactcgcgccgtcgtcgtcgtgggaggccggcggcagttcgggttcgttcacctggaactacggcctcaccctgcctccggccgcggccggccccacaccgagcctgggcctgtcgtacgactcgggcagcatcgacggacgcaccgcctccaccaacaaccagggcacccaggtcggtgaagggttcgccttcaccgagtcctacatcgagcgcacttacggcagttgcgatgacgacggccacgacaaggtcttcgaccgctgctggaagtacgacaacgcccgtctcgtcctgaacggcagctccagccgcatcatcaaggacaacaccaccggtgcctatcgtctggagaacgatgacgcctccacggtgaagcgctcgaccggcgcggacaacggggacgacaacggtgagtactggaccgtcatcaccggcgacggcacgaagtacgtgttcggcctgaacaagctcgaaggagccgctgatcagcgcaccaactccacctggacggcgccggtcttcggtgacgactccggcgagcccggctacgacaagggcagcaccttcgccgaccgctcgctgacccaggcatggcggtggaacctcgactacgttgaggacatccacggcaacgcctcgacctactggtacacgaaggaatccaaccactacccgaagaacaaggccgctaccgccaacgcctcctacatccgcggcggttacctgagcgagatcaagtacgggctgcgtaagagcgagctgttcacggatgatgccgatgcgaaggtgaccttctcgtacgccgagcgctgcactgtcacggactgcgcggagctgacggaggacacggccaagcactggcccgacgtccccttcgacagcatctgcaccagtggtgacgccgactgcaatgccgcaggcccgaccttcttcacccgtaagcgcctcaccggcatccacaccttctcgtggaacgccaccaccagcaagcacgacccggtcgactcatgggccctgacccaggaataccaagacgccggcgacatcggggacaccaccgaccatgtcctggtcctcacatcgatcaagcggacgggcaaggccggcaccgcgatcgacgtcaacccggtggtgttcacctatcaactgcgccccaaccgggtcgacggtacggatgacatcctgccgctcaagcgtcatcgcatcgagacgatcacctcggagacgggagcgatcacgacggtgacgctgtcggcaccggagtgcaagcgcagcgaggccctcgaagccgcgcaggactccaacacccgctcctgctacccacagttctggaacatcaacggcgccacggaggcgtcggtggactggttccacaagtaccgtgtgctcgcggtcggtgtcgccgatccggccgggcagaaccagacggtcgagaacgcctacgactactcgggcgccgcatggcactacgccgacgacccgttcacgccgaaggacgagcggacctggtccgagtggcgtggttatcgcgatgtcaccgtgtacgccggcgcgctgggcaccacccgttccaagacggtctcccgctacctgcagggcatgcacggggacaagaagaaggacggcaccaccaggaccgtcagcgtcgagccgctgatggacaccgacgtcgacttcgccgccctgaccgacagcgaccagtactcgggccagatgctgcagaaggttgcctacaacggcagccagcccatttcgacttcatactccaactacacgtccaagaacaccgccacgcagacagtgcccgacgcggccactcacatcgcacgctggacacgacccaacacctcgtacgcgagtacctatctgaccgcgtcgaagtcttggcgcacccacgtcgtcaccaaccgttacgacgacctgggcatggtcagagaagtcgacgactacgggcagaaaggcctgggaggtgacgagacctgcacccgcacctggtacgcccgcaacccggatgccggcatcaacagccaggtctcgcgcacccggaccgtcggcaaggaatgctccaccgccgacaccgcactcgacctgcccgtcgacgacaagcgtcgaggtgacgtccttgcggacaccgcggtcggctatgacggtgcgagcacgtggtcggaatcgatgaagccgaccaagggactggtcacctggaccggccgtgccaagggctatgcctccggcagtccgagctggcagacgatcaccagcagcagcactacggacttcgacacgctcggccgtctcaccaaggtgaccgacgcggacggtcagccgaccaccaccgcctacaccccggccaccgccggcccgctcaccaaaaccatcaccaccaatccactgggtcacaggaacacaagcttcctcgacccgcgccggggccaggcgctccgcacgtacgacgcgaacctgaagaagaccgaactcgcctacgacgcactcggccggcccacctccgtgtggctccccaaccgctcgagcgccagccagagccccagctccaagttcgcctaccacatggacaacaagaaccagtcctgggtgtcctcctcaaccctgaagaaggacggcgagacctacaccaccagctacgccatcttcgactcgctgctgcgccccctgcagacccagtcggagacaccgcagggtggccgtctgctgaccgacacccgctacgacacccgtggtctcccgtacgagtcccacgcggacattttcgacaccaccagcacccccaacggcacctacacccgcgccgaatacggtgaggcacccaagcagaccggaacagtcttcgacggggccggccgggccaccaagaccaccctgcacgttatgggcgtcgagaagtggtccaccaccaccagctacaccggtgactccaccgccaccaccgccctggacggtggcaccgccacccgcaccatcaccgacatccgcggccgtaccctcgagacccgtgaatacgccggtggcgccccggccgacccccagtacggtgacagccccggcaccagctacgcgtccacgaagttccattacacccgggacggcttgcagacgcagatcaccggcccggacgacgccaaatggtcgaacacctacgacctgttcggccgccagatcacagccgtcgatccggaccagggcaagagcaccaccgagtacgacgcgctcgaccgggccatcaagtccaccgactcccgtggcaagtcgatcctgaccgcctacgacgtcctcggccgttcgaccgggacctgggctgggtcaaagagcgacgccaaccaactcaccgccaccagctatgacgacctgctcgacggcctgccggacagcagcacccgctacgtgggtggcaagagcggccaggcgtacaccgacacgatcaccgaatacgacacgctgtcccgcccagcggtcagcaagctggaactcccctccagcgatccattcgtgaaggccggtgcaccggcgacgttggagttcgagaccgcctacaacctcgacggcaccctcaagcacaccaaagaaccggctctggggggcctgccctccgaaatcgtcgagtacgactacaacaagctcgggcaggtcacctcagtcggcggttccaccggctacctcctgaacaccgagtactcgccgatcggtcagcccacccagctcacgctaggcaccgccaacacggacgaccacaagaagtcctacctcaacaaccgctacgagcagggcaccgaccgcctgatccgcagcttcgtcaccgacgacacccacggctaccagctgcaggacctcaactacacctacgaccaaacgggcaacgtcacctccatcgccgaccccacgacactgggcggcaccagcagcgccgagacccagtgcttcgcctacgacggccaccgccgcctcaccgaagcctggacacccagctcccagaagtgctccgacgcccgcaccaccagcaacctgtccggcccggctccgtactggaccagctacacctacaacaaggcgggccagcgcaccacggaaaccacccacaagaccgccggtgacaccacgaccacctactgctacaccaaaaccgatcagccccacttcctgaccggcaccaccaccaagagcgactgcaccagcccggaaaagacctacacccccgacacgaccggcaacaccaccaagcgccccggcgcgacggcgatccaagacctcacgtggtccgaagaaggcaagctcgccaagctcaccgaaaacggcaaagccaccgactacctctacgacgcctcaggcgaactcctgatccgcagcaccgccggaggcgagaaggtgctgtacgccggcgccaccgaactacacctgcgcgccgacggcaccacctgggcccagcgctactacaccgccggtggccagaccatcgccacccgctccaacgaaggcctcagcaacaagctcacctacctggctggcgaccaccacggcacgatgtccctggccatcaacgccgacgccacccagacctacagcaagcgctacaccagccccttcggcgccgaacgcggcaagcccaccggcacaccctggcccgacgacaaggggttcctcggcaaaaccaacgacgagaccactggtctcacccacatcggcgcccgcgaatacgacccggccatcggccagttcatcagcgtcgaccccctcctcagcctcgaccagacacagtccctcaacggctacagctacgccaaccaacaccccgccacagcctccgaccccaccggtctcaaagaaggctgcggcgccacctacgccgtcagttcctgcggcaatatccctggaaagtcgggagtcaacaacgcagtcagcggaggcaaccccggcagtcccggaaactccggcagcaagaagccgtacggcggcgcgatcggcggataccacgacgtcggatacggcccctcacaggtgcgccattcgtcgccatggacgccaccgccaccggcctacttcgaagtcattgccgcaccggggcccgaacccgaccagtttgagaaagccttctccacggccctcgcgaacctgcagtccgaccgaatgtacaactacctgccaatccatgaactcatggcactggccggcgcgtcggtctgcgaggaatacatcgaatgctctcaagagttgcaccactatttcgtctggacccttcgatactcgccggaatacatcgagtcaatgggccccatggtcggaagtatcggaggaaccccgtacagccttcgcggcaagggaaaccccccggcgagcggaccgtggaaagaaacatgcaacaggtgcttccttgccgggaccgacgtcctcatggcggacggctccacaaaagacatcgaagatgtaaagctgggcgatgaggtactggcggccaacccggaaaccggcgagctgggccctcgcgaggtaactcgcctcatccgcaccgaagacgacaagcacttcaacacgctctccatcgccaccgacgacggtatagaagagctcacggcgacacacgagcacccgttctggtcgccctcagagcagagctggatagcagctggcgacctcacatcgggcatgacgctgctcaccgacgacgaccgcaccgtcattgtcacagccaacaagccctttacacagcacgcccgtacgtacaacctcactgtcgacgacctccacacgtactatgtgctggctggcaaaactccggtgctggtacataacgccggtgaatgtcctgtcactggattgccgcacggcgcccttggtgaaagtgccactcttcagaggcttcaaaatgaggggtacgcaaacatcacaagggaagtcagattcaggaatagccaaggggatgtgttccgtgccgacttcgttgcgcagaaccgctcagggaactgggtggcggtggaggtgaagaccggtagaggtgcatctctgaccggcaaccaagcgctgggatacgctgagcttggtcatggcggtgcggtgctgaatacgcgcagggtgccgggcctgaagaagggctcaacggtcacgatgaaggtagaagtggacctgtggcgctgtcctgactgctag

SEQ ID NO: 138 - DNA, 5181 bp, Streptomyces violaceusniger
gtggcgttctggatggctgctgcgtccgtatgggctgtgttgcagctcttgttgctgtcctggccggtgcggacggtgcggtggccgacggtgctgctcgccttcggggtgggtgcgtacggctgcggtgtcctctcgatggccctggaactcgtggtggcacgtcagttggcgaccgcgcgggagaaatcgctgtcgggcgtcatggatgtggtgtcgtggacgacggctccggtggtggaggagctgatcaagatcgcaccgctcctggtcgcggggtgggcactgcgcaggcggatgcagtggggtctggcggacttcgtggtgctgggcggcgctgccggggcggggttcggtctgctggaaaagcttctgatgtacgccgagtccgcgggtaaggccgttcccacggatgagggtggctggcagatcgcggggggactgttcgaccccccgtacgttcccggcctcggacagatcctcggcagttggtttccctcatcgaccggcaccgtcgacgtcgggggtccgacactcccctacgaggtgcacatcttcgccagcgcgctcggcgggctggcggtgggcttgctgtggtgtggtgcccgcgtcctgacccgggtcgcggccctggtgccgctggccggggcggtggcgatccactgggtgaccaattacgccgcggccttccctagcgaccacaccgcgatggagtggcgggagaggctggccggggagtggggcctgtggatcatcctggggtgccttgccgtcgcgtggatctgggatgtgcgccggtcccgcctgggccggcggcaccagcctgatgttgtgctggctgccgaacgccagggccggaccgcccccgaagctctcttcgggtacgccctgttgcgcctcccggccacctggatcatcgctctgggctacgcccggcagcgccgggcgctgctgtacgccacggcccacccccgtacccgcgcggagaagctggagccgctgcgcgagtcggtcgtccagcagacccaccgtatggacgcgacccaccgtcaggaggcatggcgtggcgtgaccttccggcagttgtggcgccgggcccgggagcagcgcccccgctggccgcgccacgagaaggttcttctggtgctcagcctgctgctggccgtcccctccctgctgtatctggcggtgggctccttcccgtccacgaaggatctgcaggagtacttcaccgggggcaccgggctgcgcatcctggtcggtgtcggcctggccgggctggtcctgaccctgtggcgcctgatctccgccgtacgcggctaccggaccgcgggggcgtcccctctgggcgaggcgctcgccctggtccagttccggatcgccgtctgcgcgggctccctggtcgtcggcgtcctgctgctgtcccgctggtcggcgatcgccgacggcgaggcccccctcgccggctacgacatcctcggcaccgaccgcttcctcctggaaaagctcctcgagatcggccttcccctcctcctgaccctcgccatgttcgccatgccctacgcgctgccgctggaactcgccatgggcggcggactggcggagaccctgctgatgggcctcgccccgcgcgcgctggccccgatcgcctcacgcgtcggggccaggctggcggcgcgtgaggcgacgcaatgggcgcgcggcgcactccgcagccgtggccggggcgtgttctcccgtacctgggaccgggtgcggcatggtcgtaccgatccagtggatgtggcgacggggcggatgttcctgccgcagacggatgtggagctgccgggtgtgctgccgctggtgttctcccgccgggtggactccgggtaccgcgccgggcggtggttcggcccgacctgggcctcaacggccgaccagcggctggagttcgacgagcagggcgtggtcttcttcaccgaggacggtctgctgctggcctatccgcatccggagccgggcggcaccgcggtcctgcccgcggagggaccgcggtggccactggcacggacggcggacggcggtacgtacaccgtcacggacccggatgccgggctcgtccgtaccttcgccccgtaccgcgacgaggcgcttgcgcttctgcgggagatcaccgaccgcaacggcaaccgcatcaccttcgcctacgacgcgtccggcacacccctcgaaatcctccacagcggtggctaccggctgcggctgacgtcggagaacgagcggatcaccggcctgtacgtgggggacgtacgggtgatgggctacggctacaccgacggccatctcaccgaagtgacgggctcctcggggttgccgctgcgtttcgtctacgaccgggccgggcgggtcacgtcctggatcgacaccaacaaccgctggtactcctacgcctacgacgagcaggaccgggtcgtcgccgagggcggcgagggcggccactacaccctccggatcggctacgacggggtggacccggacttccccggactgaaggtcacgactctgacctcaccggacggtgcggtcacccgctatctgatcgacgaggcacaccaggtcgtcggggagatcgacgcgggcggcgcggtcagccgcatggtgtacgaccaggccggccgtacggtcgccgagaccgacccgctgggccgcaccaccggcttccgttacgacgagcacgggcatctgacggccgtgatccggccggacggcagcgagatcagcgcagtgcccgacgcacagggcaacccggtgcagatcaccgatccgggcggcgcggtatggcggcagaccttcgacacggcgggcaaccgcaccaccctcaccgaccccctcgccgccaccacccgctacctctacgacgcacgcggaggtctgctcgccgtcaccgacccgctgggcgcgacgacccgggtgcgctgcgacgaggccgggctcccagccgagatcaccgacccgctgggagccacgagcttctaccagcgggacgcgttcggccgcgtcgtggccgagaccgacccgctgggcgcggtgacccgctacgactggagcccggagggcaaactcctgcgccgcaccggcccggacggctcggcggagtcctggacgtacgacggcgagggcaaccgcaccacgcacaccgaccccgtcggcggcacgaccgtgtacgagtacacccacttcgacctgctggccgcccgcaccggcccggacggcgtccgctacgagttcgagcatgacgcggcgctgcggctgacgagggtcaccaatcctcagggcctgaggtggagttacgagtacgacctggcgggccgcctggttacggagacggacttcgacgaccgcaatgtgcggtacgcctacgacgcagcgggccagctcaccgcccggaccgatccactgggccggatcatcacgtacgagtacgacatcgtcggccgcctgatacgcaaagcgtccgacgaccgcaccacaaccttcacctacgaccccgcagggctccttacctcggccgccgatccggacgcggaggtcgtctaccagcgcgaccgcctgggccaggtgacgtccgaaatggtgaacggccgcgtcctgacgcacacctacgaccccctgggccgccacacccgccgcaccacgcccacgggtgcgatcacgacctacgcctatgacgcggcgggcaaccgcaccaccctgaccgccgggaaccacatcctcgcctcggcacacgacgcggcgggccgcgagaccacgcgccatatcggcgacgccctcaccctcaccaacgcctgggacccgctcggccgcctgaccacgcaatcgctgaccggcgcatccagcaatgtccaccaccggacgtacgactatcgagccgacgaccacctcatcgcggtggacgacaacctgtcgggccgacgtaccttcgagctcgacgttgtgggccgggtcaccgccgtccacgcccccggctggaccgagacctacgcctacgacgaggcgggcaaccaaacgcacgcggcctggccgagcacacaacccgcccaggaggcgacgggcccccgcacttacaccggcacgcgcatcaccggtgcgggctcggtccgctacgaacacgacgaggcgggccgcctcaccctccgccaaaagacccgcctgtcccgcaaacccgacacctggcgctacacctgggacgccgaagaccgcctcgtctccgtcaccaccccggacggcacggtctggcgctacctctacgaccccttcggccgccgcaccgccaaacaacgcctggcggccgacggcgaaagcgtcctggagcaaacggatttcacctgggacggccccaccctcatagaacaaaccaccaccaccccgggcctcccccatcccgtcaccctcacctgggaccacgagggccttcaccccatagcccagaccgagcgcgtcaccgaagccaccacccaacgcgagatcgacgcccgcttcttcgcaatcgtcaccgacctggtcggcacccccaccgaactcgtcgacgattcgggcaccatcgcctggcgcacccgctccaccctctggggcaccaccacctgggcctccgacagcacggcctatacgcctctccgcttccccggccaatacttcgaccccgaaaccgggctccactacaatttccaccgctactacgaccctgattccgcccgctatctctctcccgaccctctaggtctgtcccccgcccccaatccagcgacctacagccacaaccccaacacctggttcgatcccctaggactatccccctgtccaggcggcaaccataattgggccggcaaccccgctgaacacgctcgactcaagcgcttctatgaacaagcccaaaaatacgggaaggccggttacagggaactagaaagcggaagattccgcttctacggaaagataacacccgcaacgaaggagggcgaaataatgggacgccgactcgtccgagagtgggatcccgcaactgactccactcgcatttggcacgaatcactggatcacagcggaagggtgcgcattacaaggcccgatgtaaaattcacgggcgggaaaaaggtgcattatctgttcgatggcaccggaaatctcacaggaacgttttaa

SEQ ID NO: 139 - DNA, 10188 bp, Verrucomicrobium spinosum
atgatgacgaagagcactccccgggtctttttgtgcctggccacggccgtgatggctgtgagctcatggttgactccggcctccgcccaggccccgtccggcccccagccgcgcacgggcaggttttcctacggggcgggggatgaccccacgtaccaggcgtttgtgattccgctggatttccagaagggggtgcagctctcccccacgggcattgcgccgtgggcctccgggctggactacggtgcctacccgtggttcttcaagatcgcggggcagtccagcttcctcatccagaacaacagcggcacggtgacctacccgctggaggtgcagaacccgatcgcgggcttcggcagtgagtcgggcgggacgccgctgtacattggccagagcagccgctttgccctgcacacgggggggcagtctgcggcgacagatgtgccggatgagatgagcatccgcgtgtaccggaggtcggactttgcccagcaggggaacgtggtgccggtgcaggtgcaggcgctggacatcccgcactggaagggggcctcggccacgaactcggcggcggagtggaagcagtttggtgacaacggatttcagaagacctttgtgaccacggtgggcggggtgcaggttctggaaacaacggtgcagctggcgctggaggcggggccggacggcatgtttggcgcgggctactccgcgccgttcatcatcacgcaccgggcgctgccgggtgcggaggagtactacttctctgtggcggcggtggggaacacgatggtgggcagcaacgcccactggctggcggtgagtgatccggcccagccgggcacgagcgggacgttcgtggtgggttatgccttgaacttcgagtccgccccgccctggggcaccacgctggtgaagacgccccacttccagggggagcctgcgccgcccacgtaccacgggaagacggcggaggagatccaggcgctgacgccgcggttcgagcaccagttcgccgcgcccgcgggcagcacgtacacgcagctcagccaggcgccggagctgcaggggcacaccatcctggaccgcttcgtcacggagatgggaaacaaccccatggcgctggtgaactatgtgcacaatgagatcggcctgacggatgcgctgggctacaatgagaacggggacatcgatgaggcggcggtgaatgcgggggggatcaaccgcagtgcgctggccaccttccaggaggggcagggctcgccggatgagcagtgtgcgctgctggtgtatctgctgcgcaaggcgggggtgcacgcgtcttatgtgcgctcctcgcccaatgcggtgaagatgctggaccagcgcctgagcaacctgctgcgcatgcggctcaaaggcatgcagacgccggatgggacgcagccggtgccgcagctcatcggggtgaactacccgtgggtggcggcctatgtgaatgtggacggggtgaacaagtgggtgcacctcttcccctggctgaaggacacggaggtggtggaaggcctggctgtggaagggtatctgcccagcgggacgaagagcatccgtgaatgggtgcgcaagtacctgaaggcgggggccggtgatgcgctctggacgctggatgcagaggaccgcacgccggggaacatctttctgaaggatctggacaagtccctgcaacagaactggccggggctggcgaaggacagcctgggcgtgcgcttccgcaaccggaagttcaaccgtgtgcagtggaaggagttcccccagccgacgcagttcaacacgacgacggggacgtacacgcagagcgaccgcgtgagtgcggacggttcgaggtttgacacggtggatattgagatcgccagcgtgcagttccccacgaacaaggcggtcatcaatggggtccggatcatggacatgcacaaccgccgggcggtggtgagcattgctccccgggccgaggccgggcactacgacatgaccttcaccatgcagcccttcgacctggagaatccggactccggcacgggcaactacacctacggggcagatgcgcacctgcgcaagaaacaggtgacgacgcagcatgtcagcacggtggatgaccagttcagcttcaaggtcacctaccaccgccagcgcaactatgggggtccggtgggtgtggcggatcagaatctgctgggcgggtggagccacttcgcgggcatcacgaacctggatttcggccccaaccaggcagcgcaagctggcagcgcgacgacctcttatttcaatctgggcgatctgaatgccttctgcctgaacacgggcagggtgacggaccggatgctgaaggtgcatctggagccgttctggaagcatgagcaggaacgggctgcgaactccagcatcaatccggactatgacctgatccagggcacgatggcctacttgatgggcatgtcctactaccaacgggtgtcacgctcgtttgaaacgctgaaggacacgttcaaggtgcatgcggtgtccatgcgcgcccatgggtttgcccagctgggggcggagctgaatggtacacgggacccgatcatggtgacagtgcccaaccaggcggccaagcggcccaatctggtgtacccggtggtggatatgaacttcagccgcacggcatgggccggctacggggacctgcgaccagatgcgggcggacaaggaatgatcacgggggcggacttcatgacgaacctgttcatcgcagagatctctgccctggagcaccacacgatcaaagaatacatcaaggtggaggacagtgatgctgtctccacggtggatctgattcaccgggtgcagcaggatgggaacgcgaacaccaacgtggttgagctcacagcagacaactatgtgacggagaagacgaagacctactccttcgagtcgcagacaaagacgttgcagaactgggcacccagcctgtggaccagcgtggaggcggccttttcaggttgggacaagaacctggcgcgtgtcttcatcacgcccggaccggtggcgggagcggccgggcagtggaagggcatgggggcactcatcattggcaagagccaggcgggggccttgattgggcgcatcaatggtggtgcttcgaactggctgttcggcggctccaacacgtactcatcgtccagcctgagtttcggcagctccacgatcagcatctccagcagcggcacgttgagtttttccccacagcctgcctacacgccgagctatgggtttctctcagacagctggtcgatgagctccacatccagtgtggccagcctgctgggctcggcgggtggtttcctctccagcagcagttcgtggtattacgatgtgtacagcacgccatcgggctcgctcggcagccagtttctgagcaacgtgagcaccggcatgctgctgggcaacacgagcagcacgctcacctttggtgactactacggctcgtctgggtacgggggctttgtgggggatccggtaaactccatcaccggggagctgtatgcggatgagctggatctgacgctgccgggcccgatcccgctccagatccggcgcaactacagcagccagtcccgcgcgtacggtcactttggctacggatggaagatgtcctacttcccctacatggtgccggtggatggtacggacaagctgcaggtggccgagctggatggctcggtgatcgtgtatgccagaaacacggcgaacctggcgcaggaggaatggacggtgcgcgcccaggacaacccccatctcaccaacggtgacgggctggagctgggatctgtacgcaatctcttccggaaccggatcctgcgcaccagcccgggtggtgtggtcacgtacacgttgtacggggcagatgggagcacgcgggtctatgagaaacggagctatcccgtctttggtgccagccctgccatcagccgcgaacggccgtatctgaagcggtggacggactcggcggggaactacctcgatttcaagttttttggcgacggggtttcgggggatccgtggtatgtggcgacgtcgaattcgtcctacggcgagctggcgcgggtgcaggcgagcaatggcaactactacgggttcaagtacgatgtgtatggtcacatcgtggagatctatacgggagacgggcggcgcatctcctaccggtatgacggctccggcgacctggtggaggtgacgctgccggacaactcgtgggttcgatacgactacctccatgagcagggcaaggtggggagcaccagcaacacggcgtggtcatccacccacctgatcaagaaggagatccgccccggggggcggacggtggagagcgactaccagctctatgtgcagggtgacctggacctggaggggaacgtcatcggtgccggaagcgacaagatcggcaagacctcacacctgcggcgtgtggtgcagcagagggccacggtgggcaagcacagcggaggaaacaacgaggccctgcctgcggccgagtcctatgagccggtgcgcaatgccacctacagttacttcaacagcgaggatgcgaacgggatgaccaccggccggacggagatcctggacgcgtacaaccgcaagacgatctactattacaccaacaaccggctgaccaaggtctttgacccggtgagcacggtgacgaatgccgcgacgggcgcgggcaccaatccgaagatggagcaggagtggtacacggcgctggatgtgaccaacggggtgccgggggcgtttgcggggggcttgaaatcgctgcaacaccgtggtggggtgcgcacggagttcagctacaacagcggcggggatgcgacggagatccgcgtgaaaggggacctggacggtgatggcgtctttacggatgtggcagtgacgactgccacctataacagcctgcacctgccggagctgatcacccatccgcatcccaccacggggctggccacgggcaggcgcacccgctactactaccaggatgcggcgcggccctatgcagtgacccgggtggagaaccaggatgcctctggcacggtgttgaacgcatccaccacgagctatcaggatgccttcagcaacccctccaatcaagcccaggtgccgttctgcaagggcatggtgtccaccacgaagatggcggagggcacggcagaggaggcggtgacggtctatcagcaggatgcgcgcgggttcatcaccaggagaacgggctacagcggccaggtggatcagacaaactaccctgatgtggtcatcgagtactcccacaatctccggggcgagctggtggaggagcgggtgatggagggtgtggtggccaggaaggtgaaccgctatgcctatgatgacatgggccgccgcctgtggatcgagaatttgaacgagtccggcacgcagctgggctggaactacacctactacaacctgacgggtgaggtggagtggacggacggttcaagaaccaacccggaggactacacctacacccggtacgatggcgcggggcgcaaggtggagcatgtggcctggcgctcacgggccaaggcggacggcacgggcgtggaggctgtgccaggtgtggagcagtacgccaccacgaagtacttctacaacctcttcggcgatctcatcaagatcatggacccccgcggtcatacggggaaggcaggctacgacggcattggtcgcaagacgctcacggaggcttaccagggtgactggcagaatggcggcaccttgctggccagggagacgacggcctatgatgatgccttgctgaaggtgacgcagacggattcccgcggaggggtcacgcagaaatttttcacttctgatgcgaagccgaggcggcagatcaatccggacgggacggtgctggagtggcgctactacctggacgggaggatcaagcgggaacccgtgagtgagcaccagtaccacgagtatgcctacaacgacacgacccgcaccacgacgaagacgctcaaaaatgccagcggacaaacgcagggcagtgaggtgaccacggcggatcgcaggggaaatgtagtaagctcgacgaacttcgtgggacatgtgaccacgagcacgttcgacaatctggatcgcgccatgacgaccgtgctgccagcctctggagccacgagtgccgctcaatccaccaccgtgtcctatgatgccgccggtctgaagaacaaggcggtgagcagcctgggagagagcacggaaacggtctgcgatgctctggggaggaaggtgagcgtgaccgtgaggaatgcggcaaatgcgatcatcacccagtctgcctcgacctacagcctggactcccaccaggtgaccgccaccacgggctcaggaggggagcagctgacccagtcaacctggacagacacggcgggaaggacggtcctcgtcaagcatgcggacggaacctacgcccgcacggagtatgatgcagcggggaatgccgccgcggtcacggacgagtccggccagaccacgaagaccagctacgacgggatgaaccgggtggctctgacgctgctgccggacggggctgccacgcagtatatttacacgaacctgggcgggggcgggcagaaggtggagcggctcatgcctcaagggctgaaggaagtggcgacgctggatgcggcagggcgccccacggaaagctacctggagggcagcgggggcgtgcagagccgacgctaccacacctaccagttctacacggcgggcaaggagaaggggatgctccagctgttcaccgatcctcgtggcctggtacacaccagcacgtatgatgactggcagaggatcctggccacgacggtgggcacggtggggagcccggcctatgtgaagcgggagatgctggcctatgatgtgcgggggcaggtgacccatgtcaaggaaacaacagcggccggggtcacggagatcctgcgcgcctatgacgggcaggggcacctggagtacgagaagaccaagctggatggagtggtgatctcccacctcgccaacacttatgacggctctggacgtcgcaacggtctggcacggggaggggatgtctcgcctctggggagtggtgccgggggcagctggggctttggctaccgtgcggatggcctgctggcgcaggtgagcctggggggaggcaccttcaactacacctatggcgacagcggtctgctcaagactcgcagcaaccccttccgcacctacacagtgccgggcagcggcggtcgggacaaccgcggccgggtgctggcggcgcagacgcgactgacggggcgcagcgtggacgtggtggcagaggccatctcgtggacctctgacagccgccaggccagctacgccgccacgcgtctgacagcgaacgacggcacgggcacggccacctggcaggatgcgagaaactaccaatacagtgcccagaggcgccagttgatcagcgagagctgggtgcctggtgacggccagagtgcgaggacgcaactgcacgagcatgactacggccagccgggtggtctggggatctacaccgggcgtgagacgccggctccgtctggcagcacgggcagccagttgttcctggtcaatgatgcggccatggaaggcggggcgggcatcaatgccctggggcgggtgacgcgtgaggtgagcggcttcgaaaccctggggctgaccgcgcagggaacggccaagggggcgaagaatgtggaactggtggtgaacaccaagagtgaattgagcgaagtgcagcatccggcggccacccggttcaccagcggagcgtggagccggcagctgtggatgccggcgggcgggtacaatctgctggccaaggggaaccaccccagcgggcagtttagcgcccaggcgaatgcgacgtttaacctgggggtgcggcattttggcgtggagaacctctttgatgacgatggcaatgtgacgcatcgacacatcgcgggaggatttgcccagaacggccgttctcagagcctgacctgggacgggtttggccgtctggtgaaggtggtgcaggaggagtacggtggctttggctacgaatggacggccgtgtatgacggcttcggacgcaggctgcagaccaagtacgtgccgaagcgcggcaacctctaccagacagcggagcaggtgatcgagcgctcctggtatgatccgctggttgagttcctggaagtggggatcgagataacacgtggctctgggggcgcggcggtgacggagcgctggtggaaggtgcatgggccggacctgagcggcggctacggcgggctcgtgggcatgggcggcctggaggccctggtcaatgaggccaatgcccaggcggtagggacggtggatgatgcctacggccacatcgtgggctttgccagggcgaccacgctgagtgcggccgctggtgggactctggcgttcgagtggaatgatgcgcgctttggcgggtacggaccgctctcgggttcatggagtccatccctgccagatgggttgagcgtgtggcgcgcgtttggctggcgcgggaagaggcaggatgtgacgggcttctaccatatgggggcgcggtactatgagcctgcaagcgggcgcttcctctccaccgatcccatggggcatgaggcgagcatgtcgctctatgactatgcgggtggcgaccccatcaacttcgtggatccagaaggcagaagcgccatcaacatctggagctctcccgttctgggcacgtcctatggcatctacagcgagtcctggaacagtggcagcagcagcttcggcagtgggcagtcggcagtaccgcccgcggtgcagcccaagacgggcttcttaagcggcctgtggggggggacgaaggatcttgccgttggattctgggaaggcgcagagaacatcggtcacacccttggctatgccgcagtgaacatctttgacaatgatctggcggaggaactgtacggtacgggatatcaccgcatggcagggttcacctctgaggtgggataccagctcacatccatctatgacaatgatctggcaaatgacatctacggctccacacgcaacggctttgccgacacgatcgccaactacgggctcgacctctatgagggcaatcgcaacgtgggctctgatctccagtttatcttgaaagaggcgtctgggggccaggatgcgagctgggactatcgcgccggatacgtgataccggccatcgtcagtgccatcgtggagcggaagatgagcacgggtggtggcctgccaggctactgctttgccccgggcacgccggtgctgatgggggatggctcaacccgccccgtggaaaccatccgggagggagactggatcatggccgatgatccggaagacgaacgggctgccgctccccagagggtgctcgcattgcacaaaaactggtcagaccatctgtacgaggtgcgggtggacaatgaccgggatgggctgcccgatggcgcgctcaaggcgacgggggggcatcccttctggacgaaaaaccgcggctggatcaaggtctgcaaccttcagcccaatgacatcctggcggatgccagcgggggcgattcccgggtgctggacacgaaggtcgaggaaagaatatccgccacgtacaacctgagtgtggccaacatacacaccttcttcgtcatggcgggcaaggtgcccgtgctggtgcacaacaccaatcccgggccgcgcacctacatcatctatcaggcacccatccaggggaccaaccagatctacacgggccgggccagcatgcccgggctggttagcggtacagatgtgctcgactatcggttcgctggtggacatcaccggggcatcgacttcagcagcgcgactgtggtgtcccatgtccagagtctgcagggcacaggctcagtggagtatcaggcgattcgcggtgcggagcaaatctggtacgaccgggcggtcttgaacgagcatgcagcccgtcaaatcgcgccgatcagtgcgtccaatgtgatgcgggatgactacctgcgggcagcacagacactcaaccagagcgggtcgctggatctaccctgccctcgcagatag

SEQ ID NO: 140 - DNA, 8199 bp, Homo sapiens
atggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagaaacagagataccagacatagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaa

The invention claimed is:

1. A protein of interest that is encapsulated by a shell formed by a complex consisting of:
   a) a TcB component of a bacterial toxin complex, and
   b) an N-terminal region of a TcC component of a bacterial toxin complex, wherein the N-terminal region of the TcC component extends from the N-terminus of the TcC component to a C-terminus of a RHS repeat-associated core domain, and wherein the protein of interest is heterologous to the N-terminal region of the TcC component, and the protein of interest is less than 40 kDa.

2. The encapsulated protein of interest of claim 1, wherein the RHS repeat-associated core domain conforms to the profile-HMM shown in FIG. 15.

3. A cell, composition, insecticidal composition, or pharmaceutical composition comprising the encapsulated protein of claim 1.

4. A method of controlling a pest, pest of a plant, or an insect, the method comprising contacting an encapsulated protein of claim 1 with the pest, pest of a plant, or insect wherein the protein of interest is a protein that is toxic to the pest, pest of a plant, or insect.

5. The method of claim 4 wherein the encapsulated protein is produced in the plant by expressing in the plant:

a) the TcB component of a bacterial toxin complex, and
b) a fusion protein comprising the N-terminal region of the TcC component of a bacterial toxin complex fused to the protein of interest, wherein the N-terminal region of the TcC component extends from the N-terminus of the TcC component to the C-terminus of the RHS repeat-associated core domain, and wherein the protein of interest is heterologous to the N-terminal region of the TcC component.

6. The encapsulated protein of claim 1 wherein the RHS repeat-associated core domain comprises the motif "DXXGX", where X is any amino acid.

7. The encapsulated protein of interest of claim 1, wherein the protein of interest is less than 35 kDa.

8. The encapsulated protein of interest of claim 1, wherein the protein of interest is less than 32 kDa.

* * * * *